United States Patent 11,931,406 (FLAVIVIRUS VACCINE) - sequence listing, part 4

SEQ ID NO: 3440 - protein, 3292 aa, Artificial Sequence
  derived and/or modified protein sequence (wt) from DENV-1__HM181970__SS-prME
SVTMLLMLMPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLIHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKLTVVVGDVAGILGQGKKMIRPQPMEYKYSWKSWGKAKIIGADAQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANAFDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQEDVFHTMWHVTRGAVLMYQGKRLEPSWASVKKDLISYGGGWRLRGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGHEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAVDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGTGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKAIFKLTYQNKVVRVQRPAKNGTVMDVISRRDQRGSGQVGTYGLNTFTNMEAQLIRQMESEGIFSPSELETPNLAERALDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWEDVPYLGKREDQWCGSLIGLTARATWATNIQVAINQVRRLIGNENYLDYMTSMKRFKNESDPEGALW

SEQ ID NO: 3441 - protein, 3292 aa, Artificial Sequence
  derived and/or modified protein sequence (wt) from DENV-1__GU131821__SS-prME
SVTMLLMLMPTALAFHLTTRGGEPHMIVSKQERGKSLLFKTSAGVNMCTLIAMDLGEFCEDTMTYKCPRITEAEPDDVDCWCNATDTWVTYGTCSQTGEHRRDKRSVALAPHVGLGLETRTETWMSSEGAWKQIQKVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKTVQHENLKYSVIVTVHTGDQHQVGNESTEHGTTATITPQAPSTEIQLTDYGALTLDCSPRTGLDFNEMVLLTMKEKSWLVHKQWFLDLPLPWTSGASTSQETWNRKDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTSEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSALLWMASVEPHWIAASIILEFFLMVLLIPEPDRQRTPQDNQLAYVVIGLLFMILTVAANEMGLLETTKKDLGIGHVAVENHHHATMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKSIFKLTYQNKVVRVQRPAKNGTVMDVISRRDQRGSGQVGTYGLNTFTNMEAQLIRQMESEGIFSPSELETPNLAGRVLDWLEKHGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVEWVPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3442 - protein, 3292 aa, Artificial Sequence
  derived and/or modified protein sequence (wt) from DENV-1__JF937617__SS-prME
SVTMLLMLMPTALAFHLTTRGGEPHMVVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAILRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGLGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENVMWKQISNELNHILLENDMKFTVVVGDVAGILAQGKKMIRPQPMEYKYSWKSWGKAKIMGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLVVFLLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEIGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHAAVGNHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3443 - protein, 3292 aa, Artificial Sequence
  derived and/or modified protein sequence (wt) from DENV-1__JF937618__SS-prME
SVTMLLMLMPTALAFHLTTRGGEPHMIVSKQERGKSLLFKTSAGVNMCTLIAMDLGELCEDTMTYKCPRITETEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAILRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPRNVQTTPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWTASVEPHWIAASIILEFFLMVLLIPEPDRQRTPQDNQLAYVVIGLLFMILTVAANEMGLLETTKKDLGIGHVAVGNHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3444 - protein, 3292 aa, Artificial Sequence
  derived and/or modified protein sequence (wt) from DENV-1__JF937619__SS-prME
SVTMLLMLMPTALAFHLTTRGGEPHMIVSKQERGKSLLFKTSAGVNMCTLIAMDLGELCEDTMTYKCPRITEAEPDDVDCWCNATDTWVTYGTCSQTGEHRREKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILVQGKKMIRPQPMEYKYSWKSWGKAKIIGADVQNSTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIHGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMVTFKMRPMFAVGLLFRRLTSREVLLLTIGLSLVASVELPNSLEELGDGLAMGIMILKLLTDFQSYQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWHFWQKKKQRSGVLWDTPSPPEVERAVLDDGIYRIMQRGLLGRSQVGVGVFQENVFHTMWHVTRGAVLMYQGKRLEPSWASVKKDLISYGGGWRFQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSMEAFPQSNAVIQDEERDIPERSWNSGYEWITDFPGKTVWFVPSIKAGNDIANCLRKNGKRVIQLSRKTFDTEYQKKKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGKGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTIDGIVAIDLDPVIYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDDRFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKSIFKLTYQNKVVRVQRPAKNGTVMDVISRRDQRGSGQVGTYGLNTFTNMEAQLIRQMESEGIFLPNELETPNLAGRVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTRISSWEDVPYLGKREDQWCGSLIGLTARATWATNIQVAINQVRRLIGNENYSDYMTSMKRFKNESEPEGALW

SEQ ID NO: 3445 - protein, 3292 aa, Artificial Sequence
  derived and/or modified protein sequence (wt) from DENV-1__GU131827__SS-prME
SVTMLLMLMPTALAFHLTTRGGEPHMIVSKQERGKSLLFKTSAGVNMCTLIAMDLGELCEDTMTYKCPRITETEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFRKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCAINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIVPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3446 - protein, 3292 aa, Artificial Sequence
  derived and/or modified protein sequence (wt) from DENV-1__GU131831__SS-prME
SVTMLLMLMPTALAFHLTTRGGEPHMIVSKQERGKSLLFKTSAGVNMCTLIAMDLGELCEDTMTYKCPRITETEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGISYVMCTGSFKLEKELAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMILSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3447 - protein, 3292 aa, Artificial Sequence
  derived and/or modified protein sequence (wt) from DENV-1__EU482789__SS-prME
SVTMLLMLMPTALAFHLTTRGGEPHMIVTKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLMEEQDANFVCRRTFVDRGWGNGCGLFGKGSLITCAKFKCVTKMEGKIVQYENLKYSVIVTVHTGDQHQVGNESTEHGTTATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVVGILAQGKKMIRPQPMEHKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTLSLHYAWKTMAMVLSIVSLFPLCLSTTSQKTTWLPVLLGSLGCKPLTMFLIAENKIWGRKSWPLNEGIMAVGVVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHATMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGRGRRGTGAQGETLGEKWKRQLNQLSKSEFNIYKRSGIMEVDRSEAKEGLKRGETTRHAVSRGTAKLRWFVERNLVKPEGKVIDLGCGRGGWSYYCAGLKKVTEVKGYTKGGPGHEEPIPMATYGWNLVKLHSGKDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDERFWDLVQKERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKSGTVMDVISRRDQRGSGQVGTYGLNTFTNMEAQLIRQMESEGIFLPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWGDVPYLGKREDQWCGSLIGLTARATWASNIQVAINQVRRLIGNENYLDYMTSMKRFKNEGDPEGALW

SEQ ID NO: 3448 - protein, 3292 aa, Artificial Sequence
  derived and/or modified protein sequence (wt) from DENV-1__EU482790__SS-prME
SVTMLLMLMPTALAFHLTTRGGEPHMIVSKQERGKSLLFKTSAGVNMCTLIAMDLGEFCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPSTEIQLTDYGALTLDCSPRTGLDFNEMVLLTMKEKSWLVHKQWFLDLPLPWTSGSSTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDVPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKLTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTSEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLYSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVPNLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKSIFKLTYQNKVVRVQRPAKNGTVMDVISRRDQRGSGQVGTYGLNTFTNMEAQLIRQMESEGIFSPSELETPNLAGRVLDWLEKHGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3449 - protein, 3292 aa, Artificial Sequence
  derived and/or modified protein sequence (wt) from DENV-1__EU482791__SS-prME
SVTMLLMLMPTALAFHLTTRGGEPHMIVTKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLMEEQDANFVCRRTFVDRGWGNGCGLFGKGSLITCAKFKCVTKLEGKIVQYENLKYSVIVTVHTGDQHQVGNESTEHGTTATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENGMKFTVVVGDVVGILAQGKKMIRPQPMEHKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCTSIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTLSLHYAWKTMAMVLSIVSLFPLCLSTTSQKTTWLPVLLGSLGCKPLTMFLIAENKIWGRKSWPLNEGIMAVGVVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHATMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNIYKRSGIMEVDRSEAKEGLKRGETTRHAVSRGTAKLRWFVERNLVKPEGKVIDLGCGRGGWSYYCAGLKKVTEVKGYTKGGPGHEEPIPMATYGWNLVKLHSGKDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDERFWDLVQKERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEAQLIRQMESEGIFLPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWGDVPYLGKREDQWCGSLIGLTARATWASNIQVAINQVRRLIGNENYLDYMTSMKRFKNEGDPEGALW

SEQ ID NO: 3450 - protein, 3292 aa, Artificial Sequence
  derived and/or modified protein sequence (wt) from DENV-1__EU482792__SS-prME
SVTMLLMLMPTALAFHLTTRGGEPHMIVTKQERGKSLLFKTSAGVNMCTLIAMDLGELCEDTMTYKCPRITETEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLMEEQDANFVCRRTFVDRGWGNGCGLFGKGSLITCAKFKCVTKLEGKIVQYENLKYSVIVTVHTGDQHQVGNESTEHGTTATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVVGILAQGKKMIRPQPMEHKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTLSLHYAWKTMAMVLSIVSLFPLCLSTTSQKTTWLPVLLGSLGCKPLTMFLIAENKIWGRKSWPLNEGIMAVGVVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHATMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNIYKRSGIMEVDRSEAKEGLKRGETTRHAVSRGTAKLRWFVERNLVKPEGKVIDLGCGRGGWSYYCAGLKKVTEVKGYTKGGPGHEEPIPMATYGWNLVKLHSGKDVFFTPPEKCDTLLCDIGESSPNPTIEEGRTLRVLKMVEPWLRGNQFCIKILNPYMPSVVETLEQMQRKYGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDERFWDLVQKERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEAQLIRQMESEGIFLPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWGDVPYLGKREDQWCGSLIGLTARATWASNIQVAINQVRRLIGNENYLDYMTSMKRFKNEGDPEGALW

SEQ ID NO: 3451 - protein, 3292 aa, Artificial Sequence
  derived and/or modified protein sequence (wt) from DENV-1__EU482707__SS-prME
SVTMLLMLMPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKLTVVVGDVAGILGQGKKMIRPQPMEYKYSWKSWGKAKIIGADAQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLRGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAVDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVEALEQMQRKHGGMLVRNPLSRNSTHEMYWVSCGTGNIVSAVNMTSRMLLNRFTMAHRKPTYERDVDLGTGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKAIFKLTYQNKVVRVQRPAKNGTVMDVISRRDQRGSGQVGTYGLNTFTNMEAQLIRQMESEGIFSPSELETPNLAERALDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWEDVPYLGKREDQWCGSLIGLTARATWATNIQVAINQVRRLIGNENYLDYMTSMKRFKNESDPEGALW

SEQ ID NO: 3452 - protein, 3292 aa, Artificial Sequence
  derived and/or modified protein sequence (wt) from DENV-1__EU482708__SS-prME
SVTMLLMLMPTALAFHLTTRGGEPHMIVSKQERGKSLLFKTSAGVNMCTLIAMDLGELCEDTMTYKCPRITETEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLISEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLARSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3453 - protein, 3292 aa, Artificial Sequence
  derived and/or modified protein sequence (wt) from DENV-1__EU482709__SS-prME
SVTMLLMLVPTALAFHLTTRGGEPHMIVSKQERGKSLLFKTSAGVNMCTLIAMDLGELCEDTMTYKCPRITETEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3454 - protein, 3292 aa, Artificial Sequence
  derived and/or modified protein sequence (wt) from DENV-1__EU482710__SS-prME
SVTMLLMLMPTALAFHLTTRGGEPHMIVTKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLMEEQDANFVCRRTFVDRGWGNGCGLFGKGSLITCAKFKCVTKLEGKIVQYENLKYSVIVTVHTGDQHQVGNESTEHGTTATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSVGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVVGILAQGKKMIRPQPMEHKHSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNHRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTLSLHYAWKTMAMVLSIVSLFPLCLSTTSQKTTWLPVLLGSLGCKPLTMFLITENKIWGRKSWPLNEGIMAVGVVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLISEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHATMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIIAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNIYKRSGIMEVDRSEAKEGLKRGETTRHAVSRGTAKLRWFVERNLVKPEGKVIDLGCGRGGWSYYCAGLKKVTEVKGYTKGGPGHEEPIPMATYGWNLVKLHSGKDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDERFWDLVQKERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEAQLIRQMESEGIFLPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWGDVPYLGKREDQWCGSLIGLTARATWASNIQVAINQVRRLIGNENYLDYMTSMKRFKNEGDPEGALW

SEQ ID NO: 3455 - protein, 3292 aa, Artificial Sequence
  derived and/or modified protein sequence (wt) from DENV-1__EU482712__SS-prME
SVTMLLMLMPTALAFHLTTRGGEPHMIVSKQERGKSLLFKTSAGVNMCTLIAMDLGEFCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKTVQYENLKYSVIVTVHTGDQHQVGNESTEHGTTATITPQAPSTEIQLTDYGALTLDCSPRTGLDFNEMVLLTMKEKSWLVHKQWFLDLPLPWTSGASTSQETWNRKDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKNYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVLFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTSEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKSIFKLTYQNKVVRVQRPAKNGTVMDVISRRDQRGSGQVGTYGLNTFTNMEAQLIRQMESEGIFSPSELETPNLAGRVLDWLEKHGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3456 - protein, 3292 aa, Artificial Sequence
  derived and/or modified protein sequence (wt) from DENV-1__EU249490__SS-prME
SVTMLLMLMPTALAFHLTTRGGEPHMIVSKQERGKSLLFKTSAGVNMCTLIAMDLGEFCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKTVQYENLKYSVIVTVHTGDQHQVGNESTEHGTTATITPQAPSTEIQLTDYGALTLDCSPRTGLDFNEMVLLTMKEKSWLVHKQWFLDLPLPWTSGASTSQETWNRKDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTSEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRRTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSALLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKSIFKLTYQNKVVRVQRPAKNGTVMDVISRRDQRGSGQVGTYGLNTFTNMEAQLIRQMESEGIFSPSELETPNLAGRVLDWLEKHGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3457 - protein, 3292 aa, Artificial Sequence
  derived and/or modified protein sequence (wt) from DENV-1__EU249491__SS-prME
SVTMLLMLMPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGAMVQADSGCVINWKGRELKCGSGIFVTNEVHTWTEQYKFQADSPKRLSAAIGKAWEEGVCGIRSATRLENIMWKQISNELNHILLENDMKLTVVVGDVAGILGQGKKMIRPQPMEYKYSWKSWGKAKIIGADAQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLRGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAVDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGTGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKAIFKLTYQNKVVRVQRPAKNGTVMDVISRRDQRGSGQVGTYGLNTFTNMEAQLIRQMESEGIFSPSELETPNLAERALDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWEDVPYLGKREDQWCGSLIGLTARATWATNIQVAINQVRRLIGNENYLDYMTSMKRFKNESDPEGALW

SEQ ID NO: 3458 - protein, 3292 aa, Artificial Sequence
  derived and/or modified protein sequence (wt) from DENV-1__EU249492__SS-prME
SVTMLLMLMPTALAFHLTTRGGEPHMIVSKQERGKSLLFKTSAGVNMCTLIAMDLGEFCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPSTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKLTVVVGDVAGILAQGKKMIRPQPMEYKYSWKSWGKAKIIGADVQNTTFIIDGPNTPECPDDQRAWNIWEVEDYGFGIFTTNIWLKLRDSYTQMCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSMTFIRTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVQRAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTSEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGSRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKSIFKLTYQNKVVRVQRPAKNGTVMDVISRRDQRGSGQVGTYGLNTFTNMEAQLIRQMESEGIFSPSELDTPNLAGRVLDWLEKHGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWGDVPYLGKREDQWCGSLIGLTARATWATNIQVAINQVRRLLGNENYLDYMTSMKRFKNESGPEGALW

SEQ ID NO: 3459 - protein, 3292 aa, Artificial Sequence
  derived and/or modified protein sequence (wt) from DENV-1__EU249493__SS-prME
SVTMLLMLMPTALAFHLTTRGGEPHMIVSKQERGKSLLFKTSAGVNMCTLIAMDLGEFCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKTVQYENLKYSVIVTVHTGDQHQVGNESTEHGTTATITPQAPSTEIQLTDYGALTLDCSPRTGLDFNEMVLLTMKEKSWLVHKQWFLDLPLPWTSGASTSQETWNRKDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTSEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKSIFKLTYQNKVVRVQRPAKNGTVMDVISRRDQRGSGQVGTYGLNTFTNMEAQLIRQMESEGIFSPSELETPNLAGRVLDWLEKHGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRDTACLGKSYAQMWQLMYFHRRDLRLAANAICSAVPVDWVPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3460 - protein, 3292 aa, Artificial Sequence
  derived and/or modified protein sequence (wt) from DENV-1__EU249494__SS-prME
SVTMLLMLMPTALAFHLTTRGGEPHMIVTKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLMEEQDANFVCRRTFVDRGWGNGCGLFGKGSLITCAKFKCVTKLEGKIVQYENLKYSVIVTVHTGDQHQVGNESTEHGTTATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGAMVQADSGCVINWKGRELKCGSGIFVTNEVHTWTEQYKFQADSPKRLSAAIGKAWEEGVCGIRSATRLENIMWKQISNELNHILLENDMKFTVVVGDVVGILAQGKKMIRPQPMEHKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTLSLHYAWKTMAMVLSIVSLFPLCLSTTSQKTTWLPVLLGSLGCKPLTMFLIAENKIWGRKSWPLNEGIMAVGVVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHATMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNIYKRSGIMEVDRSEAKEGLKRGETTRHAVSRGTAKLRWFVERNLVKPEGKVIDLGCGRGGWSYYCAGLKKVTEVKGYTKGGPGHEEPIPMATYGWNLVKLHSGKDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDERFWDLVQKERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEAQLIRQMESEGIFSPSELEIPNLAERVLDWLEKYGVERLKRMAISGDDCVVKPIDDRFATALTALNDMGKVRKDVPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWGDVPYLGKREDQWCGSLIGLTARATWASNIQVAINQVRRLIGNENYLDCMTSMKRFKNEGDPEGALW

SEQ ID NO: 3461 - protein, 3292 aa, Artificial Sequence
  derived and/or modified protein sequence (wt) from DENV-1__EU249495__SS-prME
SVTMLLMLMPTALAFHLTTRGGEPHMIVTKQERGKSLLFKTTAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLMEEQDANFVCRRTFVDRGWGNGCGLFGKGSLITCAKFKCVTKLEGKIVQYENLKYSVIVTVHTGDQHQVGNESTEHGTTATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVIQNGRLITANPIVTDKEKPVNIEAEPPFGESYIVIGVGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVVGILAQGKKMIRPQPMEHKYSWKSWGKAKIIGADVQNTTFIIDGPNTPECPDDQRAWNIWEVEDYGFGIFTTNIWLKLRDSYTQACDHRLMSAAIKDSKAVHADMGYWIESEKNETWKLARASFIEVKTCIWPKSHTLWSNGVLESEMVIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTLSLHYAWKTMAMVLSIVSLFPLCLSTTSQKTTWLPVLLGSLGCKPLTMFLIAENKIWGRKSWPLNEGIMAVGVVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHATMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNIYKRSGIMEVDRSEAKEGLKRGETTRHAVSRGTAKLRWFVERNLVKPEGKVIDLGCGRGGWSYYCAGLKKVTEVKGYTKGGPGHEEPIPMATYGWNLVKLHSGKDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDERFWDLVQKERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEAQLIRQMESEGIFLPSELETPNLAERVLDWLEKHGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWGDVPYLGKREDQWCGSLIGLTARATWASNIQVAINQVRRLIGNENYLDYMTSMKRFKNEGDPEGALW

SEQ ID NO: 3462 - protein, 3292 aa, Artificial Sequence
  derived and/or modified protein sequence (wt) from DENV-1__EU482794__SS-prME
SVTMLLMLMPTALAFHLTTRGGEPHMIVTKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLMEEQDANFVCRRTFVDRGWGNGCGLFGKGSLITCAKFKCVTKLEGKIVQYENLKYSVIVTVHTGDQHQVGNESTEHGTTATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSVGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVVGILAQGKKMIRPQPMEHKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTLSLHYAWKTMAMVLSIASLFPLCLSTTSQKTTWLPVLLGSLGCKPLTMFLITETKIWGRKSWPLNEGIMAVGVVSILLSSLLKNDVPLAGPLIAGGMLIACYVISGSSADLSLEKAAEVSWEEEAEHSGASHNILVVVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNYNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHATMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNIYKRSGIMEVDRSEAKEGLKRGETTRHAVSRGTAKLRWFVERNLVKPEGKVIDLGCGRGGWSYYCAGLKKVTEVKGYTKGGPGHEEPIPMATYGWNLVKLHSGKDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDERFWDLVQKERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEAQLIRQMESEGIFLPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWGDVPYLGKREDQWCGSLIGLTARATWASNIQVAINQVRRLIGNENYLDYMTSMKRFKNEGDPEGALW

SEQ ID NO: 3463 - protein, 3292 aa, Artificial Sequence
  derived and/or modified protein sequence (wt) from DENV-1__EU482795__SS-prME
SVTMLLMLMPTALAFHLTTRGGEPHMIVSKQERGKSLLFKTSAGVNMCTLIAMDLGEFCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKTVQYENLKYSVIVTVHTGDQHQVGNESTEHGTTATITPQAPSTEIQLTDYGALTLDCSPRTGLDFNEMVLLTMKEKSWLVHKQWFLDLPLPWTSGASTSQETWNRKDLLVTFKTAHAKKQEVVVLGSQEGAMHTALTGATEIQTSGTTTIFSGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLLPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTSEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRRTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSALLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKSIFKLTYQNKVVRVQRPAKNGTVMDVISRRDQRGSGQVGTYGLNTFTNMEAQLIRQMESEGIFSPSELETPNLAGRVLDWLEKHGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3464 - protein, 3292 aa, Artificial Sequence
  derived and/or modified protein sequence (wt) from DENV-1__EU482796__SS-prME
SVTMLLMLMPTALAFHLTTRGGEPHMIVTKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLMEEQDANFVCRRTFVDRGWGNGCGLFGKGSLITCAKFKCVTKLEGKIVQYENLKYSVIVTVHTGDQHQVGNESTEHGTTATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSIGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVVGILAQGKKMIRPQPMEHKYSWKSWGKAKIIGADVQNTTFIIDGPNTPECPDDQRAWNIWEVEDYGFGIFTTNIWLKMRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTLSLHYAWKTMAMVLSIVSLIPLCLSTTSQKTTWLPVLLGSLGCKPLTMFLIAENKIWGRKSWPLNEGIMAVGVVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHATMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNIYKRSGIMEVDRSEAKEGLKRGETTRHAVSRGTAKLRWFVERNLVKPEGKVIDLGCGRGGWSYYCAGLKKVTEVKGYTKGGPGHEEPIPMATYGWNLVKLHSGKDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYEKDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTVQIMEVTARWLWGFLSRNKKPRICTREEFTRKVRSNAAIGAVFVDENQWNSAKEAVEDERFWDLVKKERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEAQLIRQMESEGIFLPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWGDVPYLGKREDQWCGSLIGLTARATWASNIQVAINQVRRLIGNENYLDYMTSMKRFKNEGDPEGALW

SEQ ID NO: 3465 - protein, 3292 aa, Artificial Sequence
  derived and/or modified protein sequence (wt) from DENV-1__EU482797__SS-prME
SVTMLLMLMPTALAFHLTTRGGEPHMIVSKQERGKSLLFKTSAGVNMCTLIAMDLGEFCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKTVQYENLKYSVIVTVHTGDQHQVGNESTEHGTTATITPQAPSTEIQLTDYGALTLDCSPRTGLDFNEMVLLTMKEKSWLVHKQWFLDLPLPWTSGASTSQETWNRKDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTSEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKSIFKLTYQNKVVRVQRPAKNGTVMDVISRRDQRGSGQVGTYGLNTFTNMEAQLIRQMESEGIFSPSELETPNLAGRVLDWLEKHGVERLKRMAISGDDCVVKPIDDRFATALTALNDMGKVRKDVPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3466 - protein, 3292 aa, Artificial Sequence
  derived and/or modified protein sequence (wt) from DENV-1__EU482799__SS-prME
SVTMLLMLMPTALAFHLTTRGGEPHMIVSKQERGKSLLFKTSAGVNMCTLIAMDLGELCEDTMTYKCPRITETEPDDVDCWCNATDTWVTYGTCSQTGEHRRDKRSVALAPHVGLGLETRTETWMSSEGAWKQIQRVETWALRHPGFTVIALFLAHVIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIIIGAGEKTLKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEIHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3467 - protein, 3292 aa, Artificial Sequence
  derived and/or modified protein sequence (wt) from DENV-1__EU482800__SS-prME
SVTMLLMLMPTALAFHLTTRGGEPHMIVSKQERGKSLLFKTSAGVNMCTLIAMDLGEFCEDTMTYKCPRITEAEPDDVDCWCNATDTWVTYGTCSQTGQHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTIDSRCPTQGEATLVEEQDANFVCRRTFVDRGWGNGCGLFGKGSLITCAKFKCVTKLEGKTVQYENLKYSVIVTVHTGDQHQVGNESTEHGTTATITPQAPSTEIQLTDYGALTLDCSPRTGLDFNEMVLLTMKEKSWLVHKQWFLDLPLPWTSGASTSQETWNRKDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSVTRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTSEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMVHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKSIFKLTYQNKVVRVQRPAKNGTVMDVISRRDQRGSGQVGTYGLNTFTNMEAQLIRQMESEGIFSPSELETPNLAGRVFDWLEKHGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3468 - protein, 3292 aa, Artificial Sequence
  derived and/or modified protein sequence (wt) from DENV-1__EU482801__SS-prME
SVTMLLMLMPTALAFHLTTRGGEPHMIVSKQERGKSLLFKTSAGVNMCTLIAMDLGELCEDTMTYKCPRITETEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVGRAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISNIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3469 - protein, 3292 aa, Artificial Sequence
  derived and/or modified protein sequence (wt) from DENV-1__EU482802__SS-prME
SVTMLLMLMPTALAFHLTTRGGEPHMIVSKQERGKSLLFKTSAGVNMCTLIAMDLGEFCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKTVQYENLKYSVIVTVHTGDQHQVGNESTEHGTTATITPQAPSTEIQLTDYGALTLDCSPRTGLDFNEMVLLTMKEKSWLVHKQWFLDLPLPWTSGASTSQETWNRKDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLLPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTSEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRRTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSALLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKSKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKSIFKLTYQNKVVRVQRPAKNGTVMDVISRRDQRGSGQVGTYGLNTFTNMEAQLIRQMESEGIFSPSELETPNLAGRVLDWLEKHGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3470 - protein, 3292 aa, Artificial Sequence
  derived and/or modified protein sequence (wt) from DENV-1__EU482804__SS-prME
SVTMLLMLMPTALAFHLTTRGGEPHMIVSKQERGKSLLFKTSAGVNMCTLIAMDLGEFCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKVVQYENLKYSVIVTVHTGDQHQVGNESTEHGTTATITPQAPSTEIQLTDYGALTLDCSPRTGLDFNEMVLLTMKEKSWLVHKQWFLDLPLPWTSGASTSQETWNRKDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSTTRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFFLLITGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTSEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAAENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKSIFKLTYQNKVVRVQRPAKNGTVMDVISRRDQRGSGQVGTYGLNTFTNMEAQLIRQMESEGIFSPSELETPNLAGRVLDWLEKHGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3471 - protein, 3292 aa, Artificial Sequence
  derived and/or modified protein sequence (wt) from DENV-1__EU482806__SS-prME
SVTMLLMLMPTALAFHLTTRGGEPHMIVTKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLMEEQDANFVCRRTFVDRGWGNGCGLFGKGSLITCAKFKCVTKLEGKIVQYENLKYSVIVTVHTGDQHQVGNESTEHGTTATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVVGILAQGKKMIRPQPMEHKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTLSLHYAWKTMAMVLSIVSLFPLCLSTTSQKTTWLPVLLGSLGCKPLTMFLIAENKIWGRKSWPLNEGIMAVGVVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHATMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNIYKRSGIMEVDRSEAKEGLKRGETTRHAVSRGTAKLRWFVERNLVKPEGKVIDLGCGRGGWSYYCAGLKKVTEVKGYTKGGPGHEEPIPMATYGWNLVKLHSGKDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDERFWDLVQKERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEAQLIRQMESEGIFSPCELEIPNLAERVLDWLEKYGVERLKRMAISGDDCVVKPIDDRFATALTALNDMGKVRKDVPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWGDVPYLGKREDQWCGSLIGLTARATWASNIQVAINQVRRLIGNENYLDYMTSMKRFKNEGDPEGALW

SEQ ID NO: 3472 - protein, 3292 aa, Artificial Sequence
  derived and/or modified protein sequence (wt) from DENV-1__EU482807__SS-prME
SVTMLLMLMPTALAFHLTTRGGEPHMIVSKQERGKSLLFKTSAGVNMCTLVAMDLGEFCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKTVQYENLKYSVIVTVHTGDQHQVGNESTEHGTTATITPQAPSTEIQLTDYGALTLDCSPRTGLDFNEMVLLTMKEKSWLVHKQWFLDLPLPWTSGASTSQETWNRKDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFFLLIIGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTSEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLERMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKSIFKLTYQNKVVRVQRPAKNGTVMDVISRRDQRGSGQVGTYGLNTFTNMEAQLIRQMESEGIFSPSELETPNLAGRVLDWLEKHGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3473 - protein, 3292 aa, Artificial Sequence
  derived and/or modified protein sequence (wt) from DENV-1__EU482808__SS-prME
SVTMLLMLMPTALAFHLTTRGGEPHMIVSKQERGKSLLFKTSAGVNMCTLIAMDLGEFCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKTVQYENLKYSVIVTVHTGDQHQVGNESTEHGTTATITPQAPSTEIQLTDYGALTLDCSPRTGLDFNEMVLLTMKEKSWLVHKQWFLDLPLPWTSGASTSQETWNRKDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTSEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRDKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKSIFKLTYQNKVVRVQRPAKNGTVMDVISRRDQRGSGQVGTYGLNTFTNMEAQLIRQMESEGIFSPSELETPNLAGRVLDWLEKHGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3474 - protein, 3292 aa, Artificial Sequence
  derived and/or modified protein sequence (wt) from DENV-1__EU482809__SS-prME
SVTMLLMLMPTALAFHLTTRGGEPHMIVSKQERGKSLLFKTSAGVNMCTLIAMDLGEFCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPSTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKLTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIRTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTSEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRRLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKSIFKLTYQNKVVRVQRPAKNGTVMDVISRRDQRGSGQVGTYGLNTFTNMEAQLIRQMESEGIFSPSELETPNLAGRVLDWLEKHGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWGDVPYLGKREDQWCGSLIGLTARATWATNIQVAINQVRRLLGNENYLDYMTSMKRFKNESDPEGALW

SEQ ID NO: 3475 - protein, 3292 aa, Artificial Sequence
  derived and/or modified protein sequence (wt) from DENV-1__EU482810__SS-prME
SVTMLLMLMPTALAFHLTTRGGEPHMIVSKQERGKSLLFKTSAGVNMCTLIAMDLGEFCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPSTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKLTVVVGDVAGILAQGKKMIRPQPMEYKYSWKSWGKAKIIGADVQNTTFIIDGPNTPECPDDQRAWNIWEVEDYGFGIFTTNIWLKLRDSYTQMCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSMTFIRTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVQRAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTSEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSHKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGSRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKSIFKLTYQNKVVRVQRPAKNGTVMDVISRRDQRGSGQVGTYGLNTFTNMEAQLIRQMESEGIFSPSELDTPNLAGRVLDWLEKHGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWGDVPYLGKREDQWCGSLIGLTARATWATNIQVAINQVRRLLGNENYLDYMTSMKRFKNESGPEGALW

SEQ ID NO: 3476 - protein, 3292 aa, Artificial Sequence
  derived and/or modified protein sequence (wt) from DENV-1__EU482811__SS-prME
SVTMLLMLMPTALAFHLTTRGGEPHMIVSKQERGKSLLFKTSAGVNMCTLIAMDLGELCEDTMTYKCPRITEAEPDDVDCWCNATDTWVTYGTCSQTGEHRREKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILVQGKKMIRPQPMEYKYSWKSWGKAKIIGADVQNSTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIHGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSYQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWHFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSMEAFPQSNAVIQDEERDIPERSWNSGYEWITDFPGKTVWFVPSIKAGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGKGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTIDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDDRFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKSIFKLTYQNKVVRVQRPAKNGTVMDVISRRDQRGSGQVGTYGLNTFTNMEAQLIRQMESEGIFLPNELETPNLAGRVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTRISSWEDVPYLGKREDQWCGSLIGLTARATWATNIQVAINQVRRLIGNENYSDYMTSMKRFKNESEPEGALW

SEQ ID NO: 3477 - protein, 3292 aa, Artificial Sequence
  derived and/or modified protein sequence (wt) from DENV-1__EU482812__SS-prME
SVTMLLMLMPTALAFHLTTRGGEPHMIVSKQERGKSLLFKTSAGVNMCTLIAMDLGELCEDTMTYKCPRITETEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGATQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3478 - protein, 3292 aa, Artificial Sequence
  derived and/or modified protein sequence (wt) from DENV-1__EU482813__SS-prME
SVTMLLMLMPTALAFHLTTRGGEPHMIVSKQERGKSLLFKTSAGVNMCTLIAMDLGEFCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKTVQYENLKYSVIVTVHTGDQHQVGNESTEHGTTATITPQAPSTEIQLTDYGALTLDCSPRTGLDFNEMVLLTMKEKSWLVHKQWFLDLPLPWTSGASTSQETWNRKDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEEALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTSEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDTKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKSIFKLTYQNKVVRVQRPAKNGTVMDVISRRDQRGSGQVGTYGLNTFTNMEAQLIRQMESEGIFSPSELETPNLAGRVLDWLEKHGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3479 - protein, 3292 aa, Artificial Sequence
  derived and/or modified protein sequence (wt) from DENV-1__EU482814__SS-prME
SVTMLLMLMPTALAFHLTTRGGEPHMIVSKQERGKSLLFKTSAGVNMCTLIAMDLGEFCEDTMTYKCPRITEAEPDDVDCWCNATDTWVTYGTCSQTGEHRRDKRSVALAPHVGFGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKTVQYENLKYSVIVTVHTGDQHQVGNESTEHGTTATITPQAPSTEIQLTDYGALTLDCSPRTGLDFNEMVLLTMKEKSWLVHKQWFLDLPLPWTSGASTSQETWNRKDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTSEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKSIFKLTYQNKVVRVQRPAKNGTVMDVISRRDQRGSGQVGTYGLNTFTNMEAQLIRQMESEGIFSPSELETPNLAGRVLDWLEKHGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3480 - protein, 3292 aa, Artificial Sequence
  derived and/or modified protein sequence (wt) from DENV-1__EU482815__SS-prME
SVTMLLMLMPAALAFHLTTRGGEPHMIVSKQERGKSLLFKTSAGVNMCTLIAMDLGEFCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKTVQYENLKYSVTVTVHTGDQHQVGNESTEHGTTATITPQAPSTEIQLTDYGALTLDCSPRTGLDFNEMVLLTMKEKSWLVHKQWFLDLPLPWTSGASTSQETWNRKDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFFIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTSEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSALLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKSIFKLTYQNKVVRVQRPAKNGTVMDVISRRDQRGSGQVGTYGLNTFTNMEAQLIRQMESEGIFSPSELETPNLAGRVLDWLEKHGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3481 - protein, 3292 aa, Artificial Sequence
  derived and/or modified protein sequence (wt) from DENV-1__EU482816__SS-prME
SVTMLLMLMPTALAFHLTTRGGEPHMIVSKQERGKSLLFKTSAGVNMCTLIAMDLGEFCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKTVQYENLKYSVIVTVHTGDQHQVGNESTEHGTTATITPQAPSTEIQLTDYGALTLDCSPRTGLDFNEMVLLTMKEKSWLVHKQWFLDLPLPWTSGASTSQETWNRKDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTSEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKSIFKLTYQNKVVRVQRPAKNGTVMDVISRRDQRGSGQVGTYGLNTFTNMEAQLIRQMESEGIFSPSELETPNLAGRVLDWLEKHGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3482 - protein, 3292 aa, Artificial Sequence
  derived and/or modified protein sequence (wt) from DENV-1__EU482821__SS-prME
SVTMLLMLMPTALAFHLTTRGGEPHMIVSKQERGKSLLFKTSAGVNMCTLIAMDLGELCEDTMTYKCPRITETEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGNRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVGRAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISNIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3483 - protein, 3292 aa, Artificial Sequence
  derived and/or modified protein sequence (wt) from DENV-1__EU482822__SS-prME
SVTMLLMLMPTALAFHLTTRGGEPHMIVTKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAILRKLCIEAKISNTTTDSRCPTQGEATLMEEQDANFVCRRTFVDRGWGNGCGLFGKGSLITCAKFKCVTKLEGKIVQYENLKYSVIVTVHTGDQHQVGNESTEHGTTATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSIGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVVGILAQGKKMIRPQPMEHKYSWKSWGKAKIIGADVQNTTFIIDGPNTPECPDDQRAWNIWEVEDYGFGIFTTNIWLKMRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTLSLHYAWKTMAMVLSIVSLIPLCLSTTSQKTTWLPVLLGSLGCKPLTMFLIAENKIWGRKSWPLNEGIMAVGVVSILLSSLLKNDVPLAGPLIAGGMLIACYVISGSSADLSLEKAAEVSWEEEAEHSGASHSILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHATMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNIYKRSGIMEVDRSEAKEGLKRGETTRHAVSRGTAKLRWFVERNLVKPEGKVIDLGCGRGGWSYYCAGLKKVTEVKGYTKGGPGHEEPIPMATYGWNLVKLHSGKDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYEKDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTVQIMEVTARWLWGFLSRNKKPRICTREEFTRKVRSNAAIGAVFVDENQWNSAKEAVEDERFWDLVKKERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEAQLIRQMESEGIFLPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWGDVPYLGKREDQWCGSLIGLTARATWASNIQVAINQVRRLIGNENYLDYMTSMKRFKNEGDPEGALW

SEQ ID NO: 3484 - protein, 3292 aa, Artificial Sequence
  derived and/or modified protein sequence (wt) from DENV-1__EU482476__SS-prME
SVTMLLMLMPTALAFHLTTRGGEPHMIVTKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLMEEQDANFVCRRTFVDRGWGNGCGLFGKGSLITCAKFKCVTKLEGKIVQYENLKYSVIVTVHTGDQHQVGNESTEHGTTATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENGMKFTVVVGDVVGILAQGKKMIRPQPMEHKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCTSIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTLSLHYAWKTMAMVLSIVSLFPLCLSTTSQKTTWLPVLLGSLGCKPLTMFLIAENKIWGRKSWPLNEGIMAVGVVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHATMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNIYKRSGIMEVDRSEAKEGLKRGETTRHAVSRGTAKLRWFVERNLVKPEGKVIDLGCGRGGWSYYCAGLKKVTEVKGYTKGGPGHEEPIPMATYGWNLVKLHSGKDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDERFWDLVQKERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEAQLIRQMESEGIFLPSELETPNLAERVLDWLEKYGVERLKRMAISGDDCVVKPIDDRFATALAALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWGDVPYLGKREDQWCGSLIGLTARATWASNIQVAINQVRRLIGNENYLDYMTSMKRFKNEGDPEGALW

SEQ ID NO: 3485 - protein, 3292 aa, Artificial Sequence
  derived and/or modified protein sequence (wt) from DENV-1__EU482477__SS-prME
SVTMLLMLMPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPSTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFNLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMLAVGLLFRRLTSREVLLLTIGLSLVASVELPNSLEELGDGLAMGIMILKLLTDFQSHQLWATLLSLTFIKTTYSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTSEGEVGAIALDFKPGTSGSPIVNREGKIVGLYGNGVVTTSGTYVSAIAQAKASQEGPLPEIENEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKSIFKLTYQNKVVRVQRPAKNGTVMDVISRRDQRGSGQVGTYGLNTFTNMEAQLIRQMESEGIFSPSELETPNLAGRVLDWLEKHGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3486 - protein, 3292 aa, Artificial Sequence
  derived and/or modified protein sequence (wt) from DENV-1__EU482478__SS-prME
SVTMLLMLMPTALAFHLTTRGGEPHMIVSKQERGKSLLFKTSAGVNMCTLIAMDLGELCEDTMTYKCPRITETEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFLTQDEKGVTQNGRLITANPIVTDKEKPVNIEAEPPFGESYIIIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSHTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEIANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNEGDPEGALW

SEQ ID NO: 3487 - protein, 3292 aa, Artificial Sequence
  derived and/or modified protein sequence (wt) from DENV-1__EU482479__SS-prME
SVTMLLMLMPTALAFHLTTRGGEPHMIVSKQERGKSLLFKTSAGVNMCTLIAMDLGELCEDTMTYKCPRITETEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVICTGSFKLEKEVAETQHGTVLVQIKYEGTDAPCKIPFSTQDEKGVTQNGRLITANPIVTDKEKPVNIEAEPPFGESYIIIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSHTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVVASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYEKDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLKKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNEGDPEGALW

SEQ ID NO: 3488 - protein, 3292 aa, Artificial Sequence
  derived and/or modified protein sequence (wt) from DENV-1__EU482480__SS-prME
SVTMLLMLMPTALAFHLTTRGGEPHMIVSKQERGKSLLFKTSAGVNMCTLIAMDLGEFCEDTMTYKCPRITEAEPDDVDCWCNATDTWVTYGTCTQIGEHRRDKRSVALAPHVGLGLETRTETWMSSEGAWKQIQRVETWALRHPGFTVIALFLAHAIGTSITQKGIIFILLMLATPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTIATITPQAPSTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKLTVVVGDVAGILAQGKKMIRPQPMEYKYSWKIWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIRTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTSEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRRLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKSIFKLTYQNKVVRVQRPAKNGTVMDVISRRDQRGSGQVGTYGLNTFTNMEAQLIRQMESEGIFSPSELETPNLAGRVLDWLEKHGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWGDVPYLGKREDQWCGSLIGLTARATWATNIQVAINQVRRLLGNENYLDYMTSMKRFKNESDPEGALW

SEQ ID NO: 3489 - protein, 3292 aa, Artificial Sequence
  derived and/or modified protein sequence (wt) from DENV-1__EU482481__SS-prME
SVTMLLMLMPTALAFHLTTRGGEPHMIVTKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLMEEQDANFVCRRTFVDRGWGNGCGLFGKGSLITCAKFKCVTKLEGKIVQYENLKYSVIVTVHTGDQHQVGNESTEHGTTATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSVGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVVGILAQGKKMIRPQPMEHKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNHRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTLSLHYAWKTMAMVLSIVSLFPLCLSTTSQKTTWLPVLLGSLGCKPLTMFLITENKIWGRKSWPLNEGIMAVGVVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLISEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHATMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIIAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNIYKRSGIMEVDRSEAKEGLKRGETTRHAVSRGTAKLRWFVERNLVKPEGKVIDLGCGRGGWSYYCAGLKKVTEVKGYTKGGPGHEEPIPMATYGWNLVKLHSGKDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDERFWDLVQKERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEAQLIRQMESEGIFLPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWGDVPYLGKREDQWCGSLIGLTARATWASNIQVAINQVRRLIGNENYLDYMTSMKRFKNEGDPEGALW

SEQ ID NO: 3490 - protein, 3292 aa, Artificial Sequence
  derived and/or modified protein sequence (wt) from DENV-1__EU482482__SS-prME
SVTMLLMLMPTALAFHLTTRGGEPHMIVSKQERGKSLLFKTSAGVNMCTLIAMDLGELCEDTMTYKCPRITETEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKELAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAKRVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3491 - protein, 3292 aa, Artificial Sequence
  derived and/or modified protein sequence (wt) from DENV-1__EU482485__SS-prME
SVTMLLMLMPTALAFHLTTRGGEPHMIVSKQERGKSLLFKTSAGVNMCTLIAMDLGELCEDTMTYKCPRITETEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVGRAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISNIPGGNMYADDTAGWDTRITEDDLQNEARITDIMEPEHALLAKSIFKLTYQNKVVRVQRPTKNGTVMDVISRRDQRGSGQVGTYGLNTFTNMEAQLIRQMESEGIFSPSELETPNLAERVLDWLEKYGVERLKRMAISGDDCVVKPVDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3492 - protein, 3292 aa, Artificial Sequence
  derived and/or modified protein sequence (wt) from DENV-1__EU482486__SS-prME
SVTMLLMLMPTALAFHLTTRGGEPHMIVSKQERGKSLLFKTSAGVNMCTLIAMDLGELCEDTMTYKCPRITEVEPDDVDCWCNTTDTWVTYGTCSQTGEHRRDKRSVALAPHVGLGLETRAETWMSSEGAWKQIQKVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGLFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWRQISNELNHILLENDMKFTVVVGDVVGILAQGKKMIRPQPMEHKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFFLLIMGQLTWNDLIRSCIMVGANASDRMGMGTTYLALMATFKMRPMFAVGLLFRRLTSREVLLLTIGLSLVASVELPNSLEELGDGLAMGIMILKLLTDFQSYQLWATLLSLTFIKTTFSLHYAWKTMAMVLSIVSLLPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSALLWMASVEPHWIAASIILEFFLMVLLIPEPDRQRTPQDNQLAYVVIGLLFMILTVAANEMGLLETTKKDLGIGHVAVENHHHATMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLRRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPARNGTVMDVISRRDQRGSGQVGTYGLNTFTNMEAQLIRQMESEGIFSPSELETPNLAERVLDWLEKHGVERLKRMAISGDDCVVKPIDDRFATALSALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNDSDPEGALW

SEQ ID NO: 3493 - protein, 3292 aa, Artificial Sequence
  derived and/or modified protein sequence (wt) from DENV-1__EU482487__SS-prME
SVTMLLMLMPTALAFHLTTRGGEPHMIVSKQERGKSLLFKTSAGVNMCTLIAMDLGELCEDTMTYKCPRITETEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIIIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSHTQVCDHRLMSAAIKDSKAVHADMGYWIESAKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHAAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLKKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNEGDPEGALW

SEQ ID NO: 3494 - protein, 3292 aa, Artificial Sequence
  derived and/or modified protein sequence (wt) from DENV-1__EU482488__SS-prME
SVTMLLMLMPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPSTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKLTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIRTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTSEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRRLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKSIFKLTYQNKVVRVQRPAKNGTVMDVISRRDQRGSGQVGTYGLNTFTNMEAQLIRQMESEGIFSPSELETPNLAGRVLDWLEKHGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEDVPYLGKREDQWCGSLIGLTARATWATNIQVAINQVRRLLGNENYLDYMTSMKRFKNESDPEGALW

SEQ ID NO: 3495 - protein, 3292 aa, Artificial Sequence
  derived and/or modified protein sequence (wt) from DENV-1__EU482489__SS-prME
SVTMLLMLMPTALAFHLTTRGGEPHMIVSKQERGKSLLFKTSAGVNMCTLIAMDLGELCEDTMTYKCPRITETEPDDVDCWCNATDTWVTYGTCSQTGEHRRDKRSVALAPHVGLGLETRTETWMSSEGAWKQIQRVETWALRHPGFTLIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKELAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3496 - protein, 3292 aa, Artificial Sequence
  derived and/or modified protein sequence (wt) from DENV-1__EU482490__SS-prME
SVTMLLMLMPTALAFHLTTRGGEPHMIVSKQERGKSLLFKTSAGVNMCTLIAMDLGELCEDTMTYKCPRITETEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYITIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3497 - protein, 3292 aa, Artificial Sequence
  derived and/or modified protein sequence (wt) from DENV-1__EU482491__SS-prME
SVTMLLMLMPTALAFHLTTRGGEPHMIVSKQERGKSLLFKTSAGVNMCTLIAMDLGEFCEDTMTYKCPRITEAEPDDVDCWCNATDTWVTYGTCTQIGEHRRDKRSVALAPHVGLGLETRTETWMSSEGAWKQIQRVETWALRHPGFTVIALFLAHAIGTSITQKGIIFILLMLATPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTIATITPQAPSTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLRGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKLTVVVGDVAGILAQGKKMIRPQPMEYKYSWKIWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIRTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTSEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRRLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKSIFKLTYQNKVVRVQRPAKNGTVMDVISRRDQRGSGQVGTYGLNTFTNMEAQLIRQMESEGIFSPSELETPNLAGRVLDWLEKHGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWGDVPYLGKREDQWCGSLIGLTARATWATNIQVAINQVRRLLGNENYLDYMTSMKRFKNESDPEGALW

SEQ ID NO: 3498 - protein, 3292 aa, Artificial Sequence
  derived and/or modified protein sequence (wt) from DENV-1__EU482493__SS-prME
SVTMLLMLMPTALAFHLTTRGGEPHMIVSKQERGKSLLFKTSAGVNMCTLIAMDLGELCEDTMTYKCPRITETEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKELAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEHKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIVGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSVVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3499 - protein, 3292 aa, Artificial Sequence
  derived and/or modified protein sequence (wt) from DENV-1__EU482494__SS-prME
SVTMLLMLMPTALAFHLTTRGGEPHMIVSKQERGKSLLFKTSAGVNMCTLIAMDLGELCEDTITYKCPRITETEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLATPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLRGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEHKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3500 - protein, 3292 aa, Artificial Sequence
  derived and/or modified protein sequence (wt) from DENV-1__EU482495__SS-prME
SVTMLLMLMPTALAFHLTTRGGEPHMIVSKQERGKSLLFKTSAGVNMCTLIAMDLGELCEDTMTYKCPRITEVEPDDVDCWCNTTDTWVTYGTCSQTGEHRRDKRSVALAPHVGLGLETRAETWMSSEGAWKQIQKVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGLFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWRQISNELNHILLENDMKFTVVVGDVVGILAQGKKMIRPQPMEHKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFFLLIMGQLTWNDLIRSCIMVGANASDRMGMGTTYLALMATFKMRPMFAVGLLFRRLTSREVLLLTIGLSLVASVELPNSLEELGDGLAMGIMILKLLTDFQSYQLWATLLSLTFIKTTFSLHYAWKTMAMVLSIVSLLPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSALLWMASVEPHWIAASIILEFFLMVLLIPEPDRQRTPQDNQLAYVVIGLLFMILTVAANEMGLLETTKKDLGIGHVAVENHHHATMLDIDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLRRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPARNGTVMDVISRRDQRGSGQVGTYGLNTFTNMEAQLIRQMESEGIFSPSELETPNLAERVLDWLEKHGVERLKRMAISGDDCVVKPIDDRFATALSALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNDSDPEGALW

SEQ ID NO: 3501 - protein, 3292 aa, Artificial Sequence
  derived and/or modified protein sequence (wt) from DENV-1__EU482496__SS-prME
SVTMLLMLMPTALAFHLTTRGGEPHMIVSKQERGKSLLFKTSAGVNMCTLIAMDLGELCEDTMTYKCPRITETEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIIIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLKKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3502 - protein, 3292 aa, Artificial Sequence
  derived and/or modified protein sequence (wt) from DENV-1__EU482497__SS-prME
SVTMLLMLMPTALAFHLTTRGGEPHMIVSKQERGKSLLFKTSAGVNMCTLIAMDLGELCEDTMTYKCPRITETEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQGTWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDTMEPEHALLARSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3503 - protein, 3292 aa, Artificial Sequence
  derived and/or modified protein sequence (wt) from DENV-1__EU482499__SS-prME
SVTMLLMLMPTALAFHLTTRGGEPHMIVSKQERGKSLLFKTSAGVNMCTLIAMDLGELCEDTMTYKCPRITETEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIIIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSHTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLKKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWEDVPYLGKREDQWCGSLIGLTARATWATNIQVAINQVRRLIGNENYLDYMTSMKRFKNEGDPEGALW

SEQ ID NO: 3504 - protein, 3292 aa, Artificial Sequence
  derived and/or modified protein sequence (wt) from DENV-1__EU482500__SS-prME
SVTMLLMLMPTALAFHLTTRGGEPHMIVSKQERGKSLLFKTSAGVNMCTLIAMDLGELCEDTMTYKCPRITETEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIIIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSHTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEIANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEAEHALLAKSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNEGDPEGALW

SEQ ID NO: 3505 - protein, 3292 aa, Artificial Sequence
  derived and/or modified protein sequence (wt) from DENV-1__EU482501__SS-prME
SVTMLLMLMPTALAFHLTTRGGEPHMIVSKQERGKSLLFKTSAGVNMCTLIAMDLGELCEDTMTYKCPRITETEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVGRAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3506 - protein, 3292 aa, Artificial Sequence
  derived and/or modified protein sequence (wt) from DENV-1__EU482504__SS-prME
SVTMLLMLMPTALAFHLTTRGGEPHMIVSKQERGKSLLFKTSAGVNMCTLIAMDLGELCEDTMTYKCPRITETEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWVTLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLISEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKYGIERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3507 - protein, 3292 aa, Artificial Sequence
  derived and/or modified protein sequence (wt) from DENV-1__EU482505__SS-prME
SVTMLLMLMPTALAFHLTTRGGEPHMIVSKQERGKSLLFKTSAGVNMCTLIAMDLGEFCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKTVQYENLKYSVIVTVHTGDQHQVGNESTEHGTTATITPQAPSTEIQLTDYGALTLDCSPRTGLDFNEMVLLTMKEKAWLVHKQWFLDLPLPWTSGASTSQETWNRKDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEHKYSWKSWGKAKIIGADVQNATFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTSEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDTKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFNRENSLSGVEGEGLHKLGYILRDISKIPGGNMYADDTAGWDTRITEDDLQNEAKITDIMEPEHALLAKSIFKLTYQNKVVRVQRPAKNGTVMDVISRRDQRGSGQVGTYGLNTFTNMEAQLIRQMESEGIFSPSELETPNLAGRVLDWLEKHGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNEIDPEGALW

SEQ ID NO: 3508 - protein, 3292 aa, Artificial Sequence
  derived and/or modified protein sequence (wt) from DENV-1__EU482506__SS-prME
SVTMLLMLMPTALAFHLTTRGGEPHMIVSKQERGKSLLFKTSAGVNMCTLIAMDLGELCEDTMTYKCPRITETEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFLTQDEKGVTQNGRLITANPIVTDKEKPVNIEAEPPFGESYIIIGAGEKALKLSWFKKGSSIGKMFEATARGARRMAILGDTAWDFGSIGGVFTSVGKLVHQIFGTAYGVLFSGVSWTMKIGIGILLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIIIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNEGDPEGALW

SEQ ID NO: 3509 - protein, 3292 aa, Artificial Sequence
  derived and/or modified protein sequence (wt) from DENV-1__EU482509__SS-prME
SVTMLLMLMPTALAFHLTTRGGEPHMIVSKQERGKSLLFKTSAGVNMCTLIAMDLGELCEDTMTYKCPRITETEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFLTQDEKGVTQNGRLITANPIVTDKEKPVNIEAEPPFGESYIIIGAGEKALKLSWFKKGSSIGKMFEATARGARRMAILGDTAWDFGSIGGVFTSAGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIVPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIIIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNEGEPEGALW

SEQ ID NO: 3510 - protein, 3292 aa, Artificial Sequence
  derived and/or modified protein sequence (wt) from DENV-1__EU482510__SS-prME
SVTMLLMLMPTALAFHLTTRGGEPHMIVSKQERGKSLLFKTSAGVNMCTLIAMDLGELCEDTMTYKCPRITEVEPDDVDCWCNTTDTWVTYGTCSQTGEHRRDKRSVALAPHVGLGLETRAETWMSSEGAWKQIQKVETWALRHPGFTVIALFLAHAIGTSITQKGIIFILLMLVTPSMAMRCVGIGSRDFVEGLSGATWVDVVLEHGSCVTTMAKDKPTLDIELLRTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDGKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWRQISNELNHILLENDMKFTVVVGDVVGILAQGKKMIRPQPMEHKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFFLLIMGQLTWNDLIRSCIMVGANASDRMGMGTTYLALMATFKMRPMFAVGLLFRRLTSREVLLLTIGLSLVASVELPNSLEELGDGLAMGIMILKLLTDFQSYQLWATLLSLTFIKTTFSLHYAWKTMAMVLSIVSLLPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSALLWIASVEPHWIAASIILEFFLMVLLIPEPDRQRTPQDNQLAYVVIGLLFMILTVAANEMGLLETTKKDLGIGHVAVENHHHATMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLRRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKYGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3511 - protein, 3292 aa, Artificial Sequence
  derived and/or modified protein sequence (wt) from DENV-1__EU482511__SS-prME
SVTMLLMLMPTALAFHLTTRGGEPHMIVSKQERGKSLLFKTSAGVNMCTLIAMDLGELCEDTMTYKCPRITETEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKELAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPMSQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAKRVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3512 - protein, 3292 aa, Artificial Sequence
  derived and/or modified protein sequence (wt) from DENV-1__EU482513__SS-prME
SVTMLLMLMPTALAFHLTTRGGEPHMIVSKQERGKSLLFKTSAGVNMCTLIAMDLGELCEDTMTYKCPRITETEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKELAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3513 - protein, 3292 aa, Artificial Sequence
  derived and/or modified protein sequence (wt) from DENV-1__EU482515__SS-prME
SVTTLLMLMPTALAFHLTTRGGEPHMIVSKQERGKSLLFKTSAGVNMCTLIAMDLGELCEDTMTYKCPRITETEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKELAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPMSQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSKKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAKRVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3514 - protein, 3292 aa, Artificial Sequence
  derived and/or modified protein sequence (wt) from DENV-1__EU482516__SS-prME
SVTMLLMLMPTALAFHLTTRGGEPHMIVSKQERGKSLLFKTSAGVNMCTLIAMDLGELCEDTMTYKCPRITETEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTLSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVGRAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISNIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3515 - protein, 3292 aa, Artificial Sequence
  derived and/or modified protein sequence (wt) from DENV-1__EU482517__SS-prME
SVTMLLMLMPTALAFHLTTRGGEPHMIVSKQERGKSLLFKTSAGVNMCTLIAMDLGELCEDTMTYKCPRITETEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFNTAHAKKQEVVVLGSQEGAMHTALTGATEIQTSGTTTIFAGHLKCRLKMDKLTLKGMSYVMCTGSFKLEKELAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEHKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSAEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMDSEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3516 - protein, 3292 aa, Artificial Sequence
  derived and/or modified protein sequence (wt) from DENV-1__EU482519__SS-prME
SVTMLLMLMPTALAFHLTTRGGEPHMIVTKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVMALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLMEEQDANFVCRRTFVDRGWGNGCGLFGKGSLITCAKFKCVTKLEGKVVQYENLKYSVIVTVHTGDQHQVGNESTEHGTTATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVIQNGRLITANPIVTDKEKPVNIEAEPPFGESYIVIGVGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVVGILAQGKKMIRPQPMEHKYSWKSWGKAKIIGADVQNTTFIIDGPNTPECPDDQRAWNIWEVEDYGFGIFTTNIWLKLRDSYTQACDHRLMSAAIKDSKAVHADMGYWIESEKNETWKLARASFIEVKTCIWPKSHTLWSNGVLESEMVIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFLLLIMGQLTWNDLTRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTLSLHYAWKTMAMVLSIVSLFPLCLSTTSQKTTWLPVLLGSLGCKPLTMFLIAENKIWGRKSWPLNEGIMAVGVVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHATMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNIYKRSGIMEVDRSEAKEGLKRGETTRHAVSRGTAKLRWFVERNLVKPEGKVIDLGCGRGGWSYYCAGLKKVTEVKGYTKGGPGHEEPIPMATYGWNLVKLHSGKDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDERFWDLVQKERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEAQLIRQMESEGIFLPSELETPNLAERVLDWLEKHGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWGDVPYLGKREDQWCGSLIGLTARATWASNIQVAINQVRRLIGNENYLDYMTSMKRFKNEGDPEGALW

SEQ ID NO: 3517 - protein, 3292 aa, Artificial Sequence
  derived and/or modified protein sequence (wt) from DENV-1__EU482520__SS-prME
SVTMLLMLMPTALAFHLTTRGGEPHMIVSKQERGKSLLFKTSAGVNMCTLIAMDLGELCEDTMTYKCPRITETEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMREKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDGHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGILAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVGRAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISNIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3518 - protein, 3292 aa, Artificial Sequence
  derived and/or modified protein sequence (wt) from DENV-1__EU482521__SS-prME
SVTMLLMLMPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAILRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGRMFEATARGARRMAILGDTAWDFGSIGGVFTSVGKLVHQIFGTAYGVLFSGVSWTMKIGIGVLLTWLGLNSRSTSFSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWRSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYIWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVGNHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGEITKHAVSRGTAKLRWFVERNLVKPEGKVIDLGCGRGGWSYYCAGLKKVTEVKGYTKGGPGHEEPIPMATYGWNLVKLHSGKDVFFVPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3519 - protein, 3292 aa, Artificial Sequence
  derived and/or modified protein sequence (wt) from DENV-1__EU482523__SS-prME
SVTMLLMLMPTALAFHLTTRGGEPHMIVSKQERGKSLLFKTSAGVNMCTLIAMDLGELCEDTMTYKCPRITETEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQAAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRRMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3520 - protein, 3292 aa, Artificial Sequence
  derived and/or modified protein sequence (wt) from DENV-1__EU482525__SS-prME
SVTMLLMLMPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSFSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKLTVVVGDVAGILGQGKKMIRPQPMEYKYSWKSWGKAKIIGADAQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLRGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAVDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGTGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKAIFKLTYQNKVVRVQRPAKNGTVMDVISRRDQRGSGQVGTYGLNTFTNMEAQLIRQMESEGIFSPSELETPNLAERALDWLEKYGIERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWEDVPYLGKREDQWCGSLIGLTARATWATNIQVAINQVRRLIGNENYLDYMTSMKRFKNETDPEGALW

SEQ ID NO: 3521 - protein, 3292 aa, Artificial Sequence
  derived and/or modified protein sequence (wt) from DENV-1__EU482526__SS-prME
SVTMLLMLMPTALAFHLTTRGGEPHMIVTKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLMEEQDANFVCRRTFVDRGWGNGCGLFGKGSLITCAKFKCVTKLEGKIVQYENLKYSVIVTVHTGDQHQVGNESTEHGTTATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVVGILAQGKKMIRPQPMEHKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTLSLHYAWKTMAMVLSIVSLFPLCLSTTSQKTTWLPVLLGSLGCKPLTMFLIAENKIWGRKSWPLNEGIMAVGVVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHATMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNIYKRSGIMEVDRSEAKEGLKRGETTRHAVSRGTAKLRWFVERNLVKPEGKVIDLGCGRGGWSYYCAGLKKVTEVKGYTKGGPGHEEPIPMATYGWNLVKLHSGKDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDERFWDLVQKERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEAQLIRQMESEGIFSPSELEIPNLAERVLDWLEKYGVERLKRMAISGDDCVVKPIDDRFATALTALNDMGKVRKDVPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWGDVPYLGKREDQWCGSLIGLTARATWASNIQVAINQVRRLIGNENYLDYMTSMKRFKNEGDPEGALW

SEQ ID NO: 3522 - protein, 3292 aa, Artificial Sequence
  derived and/or modified protein sequence (wt) from DENV-1__EU482527__SS-prME
SVTMLLMLMPTALAFHLTTRGGEPHMIVSKQERGKSLLFKTSAGVNMCTLIAMDLGEFCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPSTEIQLTDYGALTLDCSPRTGLDFNEMVLLTMKEKSWLVHKQWFLDLPLPWTSGASTSQETWNRKDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDGKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVAFVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTSEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKSIFKLTYQNKVVRVQRPAKNGTVMDVISRRDQRGSGQVGTYGLNTFTNMEAQLIRQMESEGIFSPSELETPNLAGRVLDWLEKHGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3523 - protein, 3292 aa, Artificial Sequence
  derived and/or modified protein sequence (wt) from DENV-1__EU482528__SS-prME
SVTMLLMLMPTALAFHLTTRGGEPHMIVSKQERGKSLLFKTSAGVNMCTLIAMDLGEFCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKTVQYENLKYSVIVTVHTGDQHQVGNESTEHGTTATITPQAPSTEIQLTDYGALTLDCSPRTGLDFNEMVLLTMKEKSWLVHKQWFLDLPLPWTSGASTSQETWNRKDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGAMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKHSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTSEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKSIFKLTYQNKVVRVQRPAKNGTVMDVISRRDQRGSGQVGTYGLNTFTNMEAQLIRQMESEGIFSPSELETPNLAGRVLDWLEKHGVERLKRMAISGDDCVVKPIDDRFATALTALNDMGKVRKDIPQWEPSKGWNDWQQVPFCSHHFHQLIMKDGRGIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3524 - protein, 3292 aa, Artificial Sequence
  derived and/or modified protein sequence (wt) from DENV-1__EU482529__SS-prME
SVTMLLMLMPTALAFHLTTRGGEPHMIVSKQERGKSLLFKTSAGVNMCTLIAMDLGELCEDTMTYKCPRITETEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTLQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIIIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSHTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNEGDPEGALW

SEQ ID NO: 3525 - protein, 3292 aa, Artificial Sequence
  derived and/or modified protein sequence (wt) from DENV-1__EU482531__SS-prME
SVTMLLMLMPTALAFHLTTRGGEPHMIVTKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLMEEQDANFVCRRTFVDRGWGNGCGLFGKGSLITCAKFKCVTKLEGKIVQYENLKYSVIVTVHTGDQHQVGNESTEHGTTATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVIQNGRLITANPIVTDKEKPVNIEAEPPFGESYIVIGVGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVVGILAQGKKMIRPQPMEHKYSWKSWGKAKIIGADVQNTTFIIDGPNTPECPNDQRAWNIWEVEDYGFGIFTTNIWLKLRDSYTQACDHRLMSAAIKDSKAVHADMGYWIESEKNETWKLARASFIEVKTCIWPKSHTLWSNGVLESEMVIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTLSLHYAWKTMAMVLSIVSLFPLCLSTTSQKTTWLPVLLGSLGCKPLTMFLIAENKIWGRKSWPLNEGIMAVGVVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHATMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNIYKRSGIMEVDRSEAKEGLKRGETTRHAVSRGTAKLRWFVERNLVKPEGKVIDLGCGRGGWSYYCAGLKKVTEVKGYTKGGPGHEEPIPMATYGWNLVKLHSGKDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDERFWDLVQKERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEAQLIRQMESEGIFLPSELETPNLAERVLDWLEKHGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWGDVPYLGKREDQWCGSLIGLTARATWASNIQVAINQVRRLIGNENYLDYMTSMKRFKNEGDPEGALW

SEQ ID NO: 3526 - protein, 3292 aa, Artificial Sequence
  derived and/or modified protein sequence (wt) from DENV-1__EU482532__SS-prME
SVTMLLMLMPTALAFHLTTRGGEPHMIVSKQERGKSLLFKTSAGVNMCTLIAMDLGEFCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPSTEIQLTDYGALTLDCSPRTGLDFNEMVLLTMKEKSWLVHKQWFLDLPLPWTSGASTSQETWNRKDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSTTRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSHTQVCDHRLMSAAIKDSKAVHADMGYWIESEKNETWKLARASFIEVKTCIWPKSHTLWSNGVLESEMIIPKIYGGPISQHNYRSGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTSEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAAENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKSIFKLTYQNKVVRVQRPAKNGTVMDVISRRDQRGSGQVGTYGLNTFTNMEAQLIRQMESEGIFSPSELETPNLAGRVLDWLEKHGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3527 - protein, 3292 aa, Artificial Sequence
  derived and/or modified protein sequence (wt) from DENV-1__EU482533__SS-prME
SVTMLLMLMPTALAFHLTTRGGEPHMIVSKQERGKSLLFKTSAGVNMCTLIAMDLGEFCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKTVQYENLKYSVIVTVHTGDQHQVGNESTEHGTTATITPQAPSTEIQLTDYGALTLDCSPRTGLDFNEMVLLTMKEKSWLVHKQWFLDLPLPWTSGASTSQETWNRKDLLVTFKTAHAKKQEVIVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNATFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTSEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKSIFKLTYQNKVVRVQRPAKNGTVMDVISRRDQRGSGQVGTYGLNTFTNMEAQLIRQMESEGIFSPSELETPNLAGRVLDWLEKHGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3528 - protein, 3292 aa, Artificial Sequence
  derived and/or modified protein sequence (wt) from DENV-1__EU482534__SS-prME
SVTMLLMLMPTALAFHLTTRGGEPHMIVSKQERGKSLLFKTSAGVNMCTLIAMDLGEFCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPSTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKLTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFVRTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAVVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTSEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKSIFKLTYQNKVVRVQRPAKNGTVMDVISRRDQRGSGQVGTYGLNTFTNMEAQLIRQMESEGIFSPSELETPNLAGRVLDWLEKHGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWGDVPYLGKREDQWCGSLIGLTARATWATNIQVAINQVRRLLGNENYLDYMTSMKRFKNESDPEGALW

SEQ ID NO: 3529 - protein, 3292 aa, Artificial Sequence
  derived and/or modified protein sequence (wt) from DENV-1__EU482535__SS-prME
SVTMLLMLMPTALAFHLTTRGGEPHMIVTKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLMEEQDANFVCRRTFVDRGWGNGCGLFGKGSLITCAKFKCVTKLEGKIVQYENLKYSVIVTVHTGDQHQVGNESTEHGTTATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSIGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVVGILAQGKKMIRPQPMEHKYSWKSWGKAKIIGADVQNTTFIIDGPNTPECPDDQRAWNIWEVEDYGFGIFTTNIWLKMRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTLSLHYAWKTMAMVLSIVSLIPLCLSTTSQKTTWLPVLLGSLGCKPLTMFLIAENKIWGRKSWPLNEGIMAVGVVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPRKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENIDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHAAVENHHHATMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNIYKRSGIMEVDRSEAKEGLKRGETTRHAVSRGTAKLRWFVERNLVKPEGKVIDLGCGRGGWSYYCAGLKKVTEVKGYTKGGPGHEEPIPMATYGWNLVKLHSGKDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYEKDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTVQIMEVTARWLWGFLSRNKKPRICTREEFTRKVRSNAAIGAVFVDENQWNSAKEAVEDERFWDLVKKERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEAQLIRQMESEGIFLPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVNWVPTSRTTWSIHAHHQWMTTEDMLSVWNRVWIEENPWMEDKTHVSSWGDVPYLGKREDQWCGSLIGLTARATWASNIQVAINQVRRLIGNENYLDYMTSMKRFKNEGDPEGALW

SEQ ID NO: 3530 - protein, 3292 aa, Artificial Sequence
  derived and/or modified protein sequence (wt) from DENV-1__EU482536__SS-prME
SVTMLLMLMPTALAFHLTTRGGEPHMIVSKQERGKSLLFKTSAGVNMCTLIAMDLGEFCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPSTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKLTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIRTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDMLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTSEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRRLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKSIFKLTYQNKVVRVQRPAKNGTVMDVISRRDQRGSGQVGTYGLNTFTNMEAQLIRQMESEGIFSPSELETPNLAGRVLDWLEKHGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWGDVPYLGKREDQWCGSLIGLTARATWATNIQVAINQVRRLLGNENYLDYMTSMKRFKNESDPEGALW

SEQ ID NO: 3531 - protein, 3292 aa, Artificial Sequence
  derived and/or modified protein sequence (wt) from DENV-1__EU482537__SS-prME
SVTMLLMLMPTALAFHLTTRGGEPHMIVTKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLMEEQDANFVCRRTFVDRGWGNGCGLFGKGSLITCAKFKCVTKLEGKIVQYENLKYSVIVTVHTGDQHQVGNESTEHGTTATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVIQNGRLITANPIVTDKEKPVNIEAEPPFGESYIVIGVGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVVGILAQGKKMIRPQPMEHKYSWKSWGKAKIIGADVQNTTFIIDGPNTPECPDDQRAWNIWEVEDYGFGIFTTNIWLKLRDSYTQACDHRLMSAAIKDSKAVHADMGYWIESEKNETWKLARASFIEVKTCIWPKSHTLWSNGVLESEMVIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTLSLHYAWKTMAMVLSIVSLFPLCLSTTSQKTTWLPVLLGSLGCKPLTMFLIAENKIWGRKSWPLNEGIMAVGVVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHATMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNIYKRSGIMEVDRSEAKEGLKRGETTRHAVSRGTAKLRWFVERNLVKPEGKVIDLGCGRGGWSYYCAGLKKVTEVKGYTKGGPGHEEPIPMATYGWNLVKLHSGKDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDERFWDLVQKERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEAQLIRQMESEGIFLPSELETPNLAERVLDWLEKHGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWGDVPYLGKREDQWCGSLIGLTARATWASNIQVAINQVRRLIGNENYLDYMTSMKRFKNEGDPEGALW

SEQ ID NO: 3532 - protein, 3292 aa, Artificial Sequence
  derived and/or modified protein sequence (wt) from DENV-1__EU482538__SS-prME
SVTMLLMLMPTALAFHLTTRGGEPHMIVSKQERGKSLLFKTSAGVNMCTLIAMDLGEFCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPSTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDREKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKLTVVVGDVAGILAQGKKMIRPQPMEYKYSWKSWGKAKIIGADVQNTTFIIDGPNTLECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIRTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTSEGEVGAIALDFKPGTSGSPIVNREGKIVGLYGNGVVTTSGTYVSAIAQTKASQEGPLPEIEDEVFRKRNLTIMDLHPGSGKTRRYLPAIVREAIKRRLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVDRNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKSIFKLTYQNKVVRVQRPAKNGTVMDVISRRDQRGSGQVGTYGLNTFTNMEAQLIRQMESEGIFSPSELETPNLAGRVLDWLEKHGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEDVPYLGKREDQWCGSLIGLTARATWATNIQVAINQVRRLLGNENYLDYMTSMKRFKNESDPEGALW

SEQ ID NO: 3533 - protein, 3292 aa, Artificial Sequence
  derived and/or modified protein sequence (wt) from DENV-1__EU482539__SS-prME
SVTMLLMLMPTALAFHLTTRGGEPHMIVSKQERGKSLLFKTSAGVNMCTLIAMDLGELCEDTMTYKCPRITETEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVGRAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTLQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISNIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3534 - protein, 3292 aa, Artificial Sequence
  derived and/or modified protein sequence (wt) from DENV-1__KP188539__SS-prME
SVTMLLMLLPTALAFHLTTRGGEPHMIVSKQERGKSLLFKTSVGVNMCTLIAMDLGELCEDTMTYKCPRITEAEPDDVDCWCNATDTWVTYGTCSQTGEHRRDKRSVALAPHVGLGLETRTETWMSSEGAWKQIQKVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIAIITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQVKYEGTDAPCKIPFLTQDEKGVTQNGRLITANPIVTDKEKPVNIETEPPFGESYIVVGAGEKALKLSWFKKGSSIGKMFEATARGARRMAILGDTAWDFGSIGGLFTSVGKLIHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNYILLENDMKFTVVVGDVNGILAQGKKMIRPQPMEHKYSWKSWGKAKIIGADIQNTTFIIDGPDTPECPDDQRAWNIWEVEDYGFGIFTTNIWLKLRDSHTQMCDHRLMSAAIKDSKAVHADMGYWIESEKNETWKLARASFIEVKTCIWPKSHTLWSNGVLESEMVIPKIYGGPISQHNYRPGYFTQTAGPWHLGKLELDFDLCEGTTVVVDEHCGYRGPSLRTTTVTGKIIHEWCCRSCTLPPLRFRGEDGCWYGMEIRPVKEKEENLVRSMVSAGSGEMDSFSLGILCVSILIEEVMRSRWSRKMLMTGTLAVFLLLIMGQLTWNDLIRLCIMVGANASDRMGMGTTYLALMATFKMRPMFAVGLLFRRLTSREVLLLTVGLSLVASVELPNSLEELGDGLAMGIMMLKLLTDFQPHQLWTTLLSLTFIRTSLSLDYAWKTMAMALSIVSLFPLCLSTTSQKTTWLPVLLGSFGCKPLTMFLITENKIWGRKSWPINEGIMAVGIVSILLSSLLKDDVPLAGPLIAGGMLIACYVISGSSADLSLEKAAEVSWEEEAEHSGTSHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKATQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKEGPERVILAGPMPVTVASAAQRRGRIGRNQNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSSDLILEIGKLPQHLTLRAQNALDNLVMLHNSEQGGKAYRHAMEELPDTIETLMLLALIAVLTGGVTLFFLSGKGLGKTSIGLLCVMASSALLWMASVEPHWIAASIILEFFLMVLLIPEPDRQRTPQDNQLAYVVIGLLFMILTVAANEMGLLETTKKDLGIGHVAVENHHHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVTIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKKSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTAQIMEVTAKWLWGFLSRTKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKSGTVMDVISRRDQRGSGQVGTYGLNTFTNMEVQLIRQMESEGIFSPSELETPNLAKKVLDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 3535 - protein, 3292 aa, Artificial Sequence
  derived and/or modified protein sequence (wt) from DENV-1__KP188540__SS-prME
SVTMLLMLLPTALAFHLTTRGGEPHMIVSKQERGKSLLFKTSAGVNMCTLIAMDLGELCEDTMTYKCPRITEAEPDDVDCWCNATDTWVTYGTCSQTGEHRREKRSVALAPHVGLGLETRTETWMSSEGAWKQIQRVETWALRHPGFTVIAFFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKRGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNTTFIIDGPDTPECPDGQRAWNIWEVEDYGFGVFTTNIWLKLRDSYTQMCDHRLMSAAIKDSKAVHADMGYWIESEKNETWKLARASFIEVKTCTWPKSHTLWSNGVLESEMIIPKIFGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGMLCVSIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMMLKLLTEFQPHQLWTTLLSLTFVKTTLSLDYAWKTTAMVLSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEQEAEHSGASHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIENEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGATLFFLSGKGLGKTSIGLLCVTASSALLWMASVEPHWIAASIILEFFLMVLLIPEPDRQRTPQDNQLAYVVIGLLFMILTVAANEMGLLETTKKDLGIGYVAAENHQHATMLDVDLHPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEVQLIRQMESEGIFLPSELETPNLAERALDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPASRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 3536 - protein, 3292 aa, Artificial Sequence
  derived and/or modified protein sequence (wt) from DENV-1__KP188541__SS-prME
SVTMLLMLLPTALAFHLTTRGGEPHMIVSKQERGKSLLFKTSAGVNMCTLIAMDLGELCEDTMTYKCPRITEAEPDDVDCWCNATDTWVTYGTCSQTGEHRREKRSVALAPHVGLGLETRTETWMSSEGAWKQIQRVETWALRHPGFTVIAFFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKRGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNTTFIIDGPDTPECPDGQRAWNIWEVEDYGFGVFTTNIWLKLRDSYTQMCDHRLMSAAIKDSKAVHADMGYWIESEKNETWKLARASFIEVKTCTWPKSHTLWSNGVLESEMIIPKIFGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCVSIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMMLKLLTEFQPHQLWTTLLSLTFVKTTLSLDYAWKTTAMVLSIVSLFPLCLSTTSQKTTWLPVLLGSFGCKPLTMFFITENKIWGRKSWPLNEGIMAIGIVSILLSSLLKNDVPLAGPLIAGGMLIACYVISGSSADLSLEKAAEVSWEQEAEHSGASHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIENEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAVEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGYVAAENHQHATMLDVDLHPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEVQLIRQMESEGIFLPSELETPNLAERALDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPASRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 3537 - protein, 3292 aa, Artificial Sequence
  derived and/or modified protein sequence (wt) from DENV-1__KP188543__SS-prME
SVTMLLMLLPTALAFHLTTRGGEPHMIVSKQERGKSLLFKTSVGVNMCTLIAMDLGELCEDTMTYKCPRITEVEPDDVDCWCNATDTWVTYGTCSQTGEHRRDKRSVALAPHVGLGLETRTETWMSSEGAWKQIQKVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQVKYEGTDAPCKIPFLTQDEKGVTQNGRLITANPIVTDKEKPVNIETEPPFGESYIVVGAGEKALKLSWFKKGSSIGKMFEATARGARRMAILGDTAWDFGSIGGLFTSVGKLIHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNYILLENDMKFTVVVGDVNGILAQGKKMIRPQPMEHKYSWKSWGKAKIIGADIQNTTFIIDGPDTPECPDDQRAWNIWEVEDYGFGIFTTNIWLKLRDSHTQMCDHRLMSAAIKDSKAVHADMGYWIESEKNETWKLARASFIEVKTCIWPKSHTLWSNGVLESEMVIPKIYGGPISQHNYRPGYFTQTAGPWHLGKLELDFDLCEGTTVVVDEHCGYRGPSLRTTTVTGKIIHEWCCRSCTLPPLRFRGEDGCWYGMEIRPVKEKEENLVRSMVSAGSGEMDSFSLGILCVSILIEEVMRSRWSRKMLMTGTLAVFLLLIMGQLTWNDLIRLCIMVGANASDRMGMGTTYLALMATFKMRPMFAVGLLFRRLTSREVLLLTVGLSLVASVELPNSLEELGDGLAMGIMMLKLLTDFQPHQLWTTLLSLTFIRTSLSLDYAWKTMAMALSIVSLFPLCLSTTSQKTTWLPVLLGSFGCKPLTMFLITENKIWGRKSWPINEGIMAVGIVSILLSSLLKNDVPLAGPLIAGGMLIACYVISGSSADLSLEKAAEVSWEEEAEHSGTSHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKATQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKEGPERVILAGPMPVTVASAAQRRGRIGRNQNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVMASSALLWMASVEPHWIAASIILEFFLMVLLIPEPDRQRTPQDNQLAYVVIGLLFMILTVAANEMGLLETTKKDLGIGHVAVENHHHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVTIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKKSGIMEVDRSEAKEGLKRGETTKHAVSRGTAKLRWFVERNLVKPEGKVVDLGCGRGGWSYYCAGLKKVTEVKGYTKGGPGHEEPIPMATYGWNLVKLHSGKDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKSGTVMDVISRRDQRGSGQVGTYGLNTFTNMEVQLIRQMESEGIFSPSELETPNLAKKVLDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMENKTHVSSWEEVPYLGKREDQWCGSLIGLTARATWATNIQVAINQVRRLIGNENYLDYMTSMKRFKNESDPEGALW

SEQ ID NO: 3538 - protein, 3292 aa, Artificial Sequence
  derived and/or modified protein sequence (wt) from DENV-1__KP188544__SS-prME
SVTMLLMLLPTALAFHLTTRGGEPHMIVSKQERGKSLLFKTSVGVNMCTLIAMDLGELCEDTMTYKCPRITEAEPDDVDCWCNATDTWVTYGTCSQTGEHRRDKRSVALAPHVGLGLETRTETWMSSEGAWKQIQKVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQVKYEGTDAPCKIPFLTQDEKGVTQNGRLITANPIVTDKEKPVNIETEPPFGESYIVVGAGEKALKLSWFKKGSSIGKMFEATARGARRMAILGDTAWDFGSIGGLFTSVGKLIHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNYILLENDMKFTVVVGDVNGILAQGKKMIRPQPMEHKYSWKSWGKAKIIGADIQNTTFIIDGPDTPECPDDQRAWNIWEVEDYGFGIFTTNIWLKLRDSHTQMCDHRLMSAAIKDSKAVHADMGYWIESEKNETWKLARASFIEVKTCIWPKSHTLWSNGVLESEMVIPKIYGGPISQHNYRPGYFTQTAGPWHLGKLELDFDLCEGTTVVVDEHCGYRGPSLRTTTVTGKIIHEWCCRSCTLPPLRFRGEDGCWYGMEIRPVKEKEENLVRSMVSAGSGEVDSFSLGILCVSILIEEVMRSRWSRKMLMTGTLAVFLLLIMGQLTWNDLIRLCIMVGANASDRMGMGTTYLALMATFKMRPMFAVGLLFRRLTCREVLLLTVGLSLVASVELPNSLEELGDGLAMGIMMLKLLTDFQPHQLWTTLLSLTFIRTSLSLDYAWKTMAMALSIVSLFPLCLSTTSQKTTWLPVLLGSFGCKPLTMFLITENKIWGRKSWPINEGIMAVGIVSILLSSLLKNDVPLAGPLIAGGMLIACYVISGSSADLSLEKAAEVSWEEEAEHSGTSHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMHQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKATQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKEGPERVILAGPMPVTVASAAQRRGRIGRNQNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVMASSALLWMASVEPHWIAASIILEFFLMVLLIPEPDRQRTPQDNQLAYVVIGLLFMILTVAANEMGLLETTKKDLGIGHVAVENHHHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVTIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKKSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHHDEDNPYKTWAYHGSYEVKPSGSASSMVNGVVRLLTKPWDVIPMVTQIAMTDTTPFGQQRVFKEKVDTRTPRAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKSGTVMDVISRRDQRGSGQVGTYGLNTFTNMEVQLIRQMESEGIFSPSELETPNLAKKVLDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 3539 - protein, 3292 aa, Artificial Sequence
  derived and/or modified protein sequence (wt) from DENV-1__KP188547__SS-prME
SVTMLLMLLPTALAFHLTTRGGEPHMIVSKQERGKSLLFKTSVGVNMCTLIAMDLGELCEDTMTYKCPRITEAEPDDVDCWCNATDTWVTYGTCSQTGEHRRDKRSVALAPHVGLGLETRTETWMSSEGAWKQIQKVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAILRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQVKYEGTDAPCKIPFLTQDEKGVTQNGRLITANPIVTDKEKPVNIETEPPFGESYIVVGAGEKALKLSWFKKGSSIGKMFEATARGARRMAILGDTAWDFGSIGGLFTSVGKLIHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNYILLENDMKFTVVVGDVNGILAQGKKMIKPQPMEHKYSWKSWGKAKIIGADIQNTTFIIDGPDTPECPDDQRAWNIWEVEDYGFGIFTTNIWLKLRDSHTQMCDHRLMSAAIKDSKAVHADMGYWIESEKNETWKLARASFIEVKTCIWPKSHTLWSNGVLESEMVIPKIYGGPISQHNYRPGYFTQTAGPWHLGKLELDFDLCEGTTVVVDEHCGYRGPSLRTTTVTGKIIHEWCCRSCTLPPLRFRGEDGCWYGMEIRPVKEKEENLVRSMVSAGSGEVDSFSLGILCVSILIEEVMRSRWSRKMLMTGTLAVFLLLIMGQLTWNDLIRLCIMVGANALDRMGMGTTYLALMATFKMRPMFAVGLLFRRLTSREVLLLTVGLSLVASVELPSSLEELGDGLAMGIMMLKLLTDFQPHQLWTTLLSLTFIRTSLSLDYAWKTMAMALSIVSLFPLCLSTTSQKTTWLPVLLGSFGCKPLTMFLITENKIWGRKSWPINEGIMAVGIVSILLSSLLKNDVPLAGPLIAGGMLIACYVISGSSADLSLEKAAEVSWEEEAEHSGTSHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKATQEGTLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKEGPERVILAGPMPVTVASAAQRRGRIGRNQNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVMASSALLWMASVEPHWIAASIILEFFLMVLLIPEPDRQRTPQDNQLAYVVIGLLFMILTVAANEMGLLETTKKDLGIGHVAVENHHHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVTIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKKSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKSGTVMDVISRRDQRGSGQVGTYGLNTFTNMEVQLIRQMESEGIFSPSELETPNLAKKVLDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 3540 - protein, 3292 aa, Artificial Sequence
  derived and/or modified protein sequence (wt) from DENV-1__KP723473__SS-prME
SVTMLLMLLPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWRQIQKVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGVSYVMCTGSFKLEKEVAETQHGTVLVQVKYEGTDAPCKIPISTQDEKGVTQNGRLITANPIVTDKEKPVNIETEPPFGESYIVIGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILTQGKKMIRPQPMEHKYSWKSWGKAKIIGADTQNTTFIIDGPDTPECPDDQRAWNIWEVEDYGFGVFTTNIWLKLRDSYTQMCDHRLMSAAIKDSKAVHADMGYWIESEKNETWKLARASFIEVKTCIWPRSHTLWSNGVLESEMIIPKIYGGPISQHNYRPGYFTQTAGPWHLGKLELDFNLCEGTTVVVDEHCGNRGPSLRTTTVTGKIIHEWCCRSCTLPPLRFRGEDGCWYGMEIRPVKEKEENLVRSMVSAGSGEVDSFSLGLLCVSIMIEEVMRSRWSRKMLMTGTLAVFFLLIMGQLTWNDLIRLCIMVGANVSDRMGMGTTYLALMATFKMRPMFAVGLLFRRLTSREVLLLTIGLSLVASVELPNSLEELGDGLAMGIMMLKLLTDFQSHQLWTTLLSLTFIKTTLSLDYAWKTMAMVLSIVSLFPLCLSTTSQKTTWLPVLLGSFGCKPLTMFLITENKIWGRKSWPLNEGIMAVGIVSILLSSLLKNDVPLAGPLIAGGMLIACYVISGSSADLSLERAAEVSWEEEAEHSGASHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTAASAAQRRGRIGRNQNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKCDSRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVMASSVLLWMASVEPHWIAASIILEFFLMVLLIPEPDRQRTPQDNQLAYVVIGLLFMILTVAANEMGLLETTKKDLGIGHVVAENHHHATMLDIDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNIVKLHSGRDVFFTPPEKCDTLLCDIGESSPNPTIEEGRTLRVLKMVEPWLRGIQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEIANLDIIGQRIENIKNEHKSTWHYDEDNPYKTWAYHGSYEVKPSGTASSMVNGVVRLLTKPWDVIPMVTQIAMTDTTPFGQQRVFKEKVDTRTPRPKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKSGTVMDVISRRDQRGSGQVGTYGLNTFTNMEVQLIRQMESEGIFSPSELENSNLAERVLDWLEKHGVERLKRMAISGDDCVVKPTDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVNWVPTSRTTWSIHAHHQWMTTEDMLSVWNRVWIEENPWMEDKTHVSSWEDVPYLGKREDQWCGSLIGLTARATWATNIQVAINQVRRLIGNENYLDYMTSMKRFKNESDPEGALW

SEQ ID NO: 3541 - protein, 3292 aa, Artificial Sequence
  derived and/or modified protein sequence (wt) from DENV-1__KT187564__SS-prME
SVTMLLMLMPTALAFHLTTRGGEPHMMVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKGKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMIGTLAVFFLLIMGQLTWNDLIRLCIMVGANASDRMGMGTTYLALMATFKMRPMFAVGLLFRRLTSREVLLLTIGLSLVASAELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVFPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRRLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFIDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKAIFKLTYQNKVVRVQRPAKNGTVMDVISRRDQRGSGQVGTYGLNTFTNMEAQLIRQMESEGIFSPSELETPNLAERVLDWLGKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISNWEDVPYLGKREDQWCGSLIGLTARATWATNIQVAINQVRRLIGNENYLDYMTSMKRFKNESDPEGALW

SEQ ID NO: 3542 - protein, 3292 aa, Artificial Sequence
  derived and/or modified protein sequence (wt) from DENV-1__KT187560__SS-prME
SVTMLLMLLPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWRQIQKVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGVSYVMCTGSFKLEKEVAETQHGTVLVQVKYEGTDAPCKIPISTQDEKGVTQNGRLITANPIVTDKEKPVNIETEPPFGESYIVIGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILTQGKKMIRPQPMEHKYSWKSWGKAKIIGADTQNTTFIIDGPDTPECPDDQRAWNIWEVEDYGFGVFTTNIWLKLRDSYTQMCDHRLMSAAIKDSKAVHADMGYWIESEKNETWKLARASFIEVKTCIWPRSHTLWSNGVLESEMIIPKIYGGPISQHNYRPGYFTQTAGPWHLGKLELDFNLCEGTTVVVDEHCGNRGPSLRTTTVTGKIIHEWCCRSCTLPPLRFRGEDGCWYGMEIRPVKEKEENLVRSMVSAGSGEVDSFSLGLLCVSIMIEEVMRSRWSRKMLMTGTLAVFFLLIMGQLTWNDLIRLCIMVGANVSDRMGMGTTYLALMATFKMRPMFAVGLLFRRLTSREVLLLTIGLSLVASVELPNSLEELGDGLAMGIMMLKLLTDFQSHQLWTTLLSLTFIKTTLSLDYAWKTMAMVLSIVSLFPLCLSTTSQKTTWLPVLLGSLGCKPLTMFLITENKIWGRKSWPLNEGIMAVGIVSILLSSLLKNDVPLAGPLIAGGMLIACYVISGSSADLSLERAAEVSWEEEAEHSGASHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTAASAAQRRGRIGRNQNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVMASSVLLWMASVEPHWIAASIILEFFLMVLLIPEPDRQRTPQDNQLAYVVIGLLFMILTVAANEMGLLETTKKDLGIGHVVAENHHHATMLDIDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNIVKLHSGRDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEIANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRPKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKSGTVMDVISRRDQRGSGQVGTYGLNTFTNMEVQLIRQMESEGIFSPSELENSNLAERVLDWLEKHGVERLKRMAISGDDCVVKPTDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVNWVPTSRTTWSIHAHHQWMTTEDMLSVWNRVWIEENPWMEDKTHVSSWEDVPYLGKREDQWCGSLIGLTARATWATNIQVAINQVRRLIGNENYLDYMTSMKRFKNESDPEGALW

SEQ ID NO: 3543 - protein, 3292 aa, Artificial Sequence
  derived and/or modified protein sequence (wt) from DENV-1__KT187561__SS-prME
SVTMLLMLLPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWRQIQKVETWALRHPGFTVIAFFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGVSYVMCTGSFKLEKEVAETQHGTVLVQVKYEGTDAPCKIPISTQDEKGVTQNGRLITANPIVTDKEKPVNIETEPPFGESYIVIGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILTQGKKMIRPQPMEHKYSWKSWGKAKIIGADTQNTTFIIDGPDTPECPDDQRAWNIWEVEDYGFGVFTTNIWLKLRDSYTQMCDHRLMSAAIKDSKAVHADMGYWIESEKNETWKLARASFIEVKTCIWPRSHTLWSNGVLESEMIIPKIYGGPISQHNYRPGYFTQTAGPWHLGKLELDFNLCEGTTVVVDEHCGNRGPSLRTTTVTGKIIHEWCCRSCTLPPLRFRGEDGCWYGMEIRPVKEKEENLVRSMVSAGSGEVDSFSLGLLCVSIMIEEVMRSRWSRKMLMTGTLAVFFLLIMGQLTWNDLIRLCIMVGANVSDRMGMGTTYLALMATFKMRPMFAVGLLFRRLTSREVLLLTIGLSLVASVELPNSLEELGDGLAMGIMMLKLLTDFQSHQLWTTLLSLTFIKTTLSLDYAWKTMAMVLSIVSLFPLCLSTTSQKTTWLPVLLGSFGCKPLTMFLITENKIWGRKSWPLNEGIMAVGIVSILLSSLLKNDVPLAGPLIAGGMLIACYVISGSSADLSLERAAEVSWEEEAEHSGASHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTAASAAQRRGRIGRNQNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVMASSVLLWMASVEPHWIAASIILEFFLMVLLIPEPDRQRTPQDNQLAYVVIGLLFLILTVAANEMGLLETTKKDLGIGHVVAENHHHATMLDIDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNIVKLHSGRDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEIANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRPKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKSGTVMDVISRRDQRGSGQVGTYGLNTFTNMEVQLIRQMESEGIFSPSELENSNLAERVLDWLEKHGVERLKRMAISGDDCVVKPTDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVNWVPTSRTTWSIHAHHQWMTTEDMLSVWNRVWIEENPWMEDKTHVSSWEDVPYLGKREDQWCGSLIGLTARATWATNIQVAINQVRRLIGNENYLDYMTSMKRFKNESDPEGALW

SEQ ID NO: 3544 - protein, 3292 aa, Artificial Sequence
  derived and/or modified protein sequence (wt) from DENV-1__KT187562__SS-prME
SVTMLLMLLPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWRQIQKVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGVSYVMCTGSFKLEKEVAETQHGTVLVQVKYEGTDAPCKIPISTQDEKGVTQNGRLITANPIVTDKEKPVNIETEPPFGESYIVIGAGEKTLKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILTQGKKMIRPQPMEHKYSWKSWGKAKIIGADTQNTTFIIDGPDTPECPDDQRAWNIWEVEDYGFGVFTTNIWLKLRDSYTQMCDHRLMSAAIKDSKAVHADMGYWIESEKNETWKLARASFIEVKTCIWPRSHTLWSNGVLESEMIIPKIYGGPISQHNYRPGYFTQTAGPWHLGKLELDFNLCEGTTVVVDEHCGNRGPSLRTTTVTGKIIHEWCCRSCTLPPLRFRGEDGCWYGMEIRPVKEKEENLVRSMVSAGSGEVDSFSLGLLCVSIMIEEVMRSRWSRKMLMTGTLAVFFLLIMGQLTWNDLIRLCIMVGANVSDRMGMGTTYLALMATFKMRPMFAVGLLFRRLTSREVLLLTIGLSLVASVELPNSLEELGDGLAMGIMMLKLLTDFQSHQLWTTLLSLTFIKTTLSLDYAWKTMAMVLSIVSLFPLCLSTTSQKTTWLPVLLGSFGCKPLTMFLITENKIWGRKSWPLNEGIMAVGIVSILLSSLLKNDVPLAGPLIAGGMLIACYVISGSSADLSLERAAEVSWEEEAEHSGASHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTAASAAQRRGRIGRNQNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVMASSVLLWMASVEPHWIAASIILEFFLMVLLIPEPDRQRTPQDNQLAYVVIGLLFMILTVAANEMGLLETTKKDLGIGHVVAENHHHATMLDIDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNIVKLHSGRDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEIANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRPKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKSGTVMDVISRRDQRGSGQVGTYGLNTFTNMEVQLIRQMESEGIFSPSELENSNLAERVLDWLEKHGVERLKRMAISGDDCVVKPTDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVNWVPTSRTTWSIHAHHQWMTTEDMLSVWNRVWIEENPWMEDKTHVSSWEDVPYLGKREDQWCGSLIGLTARATWATNIQVAINQVRRLIGNENYLDYMTSMKRFKNESDPEGALW

SEQ ID NO: 3545 - protein, 3292 aa, Artificial Sequence
  derived and/or modified protein sequence (wt) from DENV-1__JQ045628__SS-prME
SVTMLLMLMPTALAFHLTTRGGEPHMIVSKQERGKSLLFKTSAGVNMCTLIAMDLGELCEDTMTYKCPRITETEPDDVDCWCNATDTWVTYGTCSQTGEHRRDKRSVALAPHVGLGLETRTETWMSSEGAWKQIQRVETWALRHPGFTVIAFFLAHAIGTSITQKGIIFILLMLVTPSMAMRCVGIGSRDFVEGLSGATWVDVVLEHGSCVTTMAKDKPTLDIELLKTEVTNPAILRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTTPGTFKTLEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVIASSVLLWMASVEPHWIAASIILEFFLMVLLIPEPDRQRTPQDNQLAYVVIGLLFMILTVAANEMGLLETTKKDLGIGHVAVGNHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3546 - protein, 3292 aa, Artificial Sequence
  derived and/or modified protein sequence (wt) from DENV-1__JQ045629__SS-prME
SVTMLLMLMPTALAFHLTTRGGEPHMMVSKQERGKSLLFKTSAGVNMCTLIAMDLGELCEDTMTYKCPRITETEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKELAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSHTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3547 - protein, 3292 aa, Artificial Sequence
  derived and/or modified protein sequence (wt) from DENV-1__JQ045630__SS-prME
SVTMLLMLMPTALAFHLTTRGGEPHMIVSKQERGKSLLFKTSAGVNMCTLIAMDLGELCEDTMTYKCPRITETEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAILRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVIASSVLLWMASVEPHWIAASIILEFFLMVLLIPEPDRQRTPQDNQLAYVVIGLLFMILTVAANEMGLLETTKKDLGIGHVAVGNHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3548 - protein, 3292 aa, Artificial Sequence
  derived and/or modified protein sequence (wt) from DENV-1__JQ045632__SS-prME
SVTMLLMLMPTALAFHLTTRGGEPHMIVSKQERGKSLLFKTSAGVNMCTLIAMDLGELCEDTMTYKCPRITETEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKELAETQHGTVLVQIKYEGTDAPCKIPFLTQDEKGVTQNGRLITANPIVTDKEKPVNIEAEPPFGESYIVIGAGEKALKLSWFKKGSSIGKMFEATARGARRMAILGDTAWDFGSIGGVFTSIGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEHKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLKKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLILLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKVLNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3549 - protein, 3292 aa, Artificial Sequence
  derived and/or modified protein sequence (wt) from DENV-1__JQ045633__SS-prME
SVTMLLMLMPTALAFHLTTRGGEPHMIVSKQERGKSLLFKTSAGVNMCTLIAMDLGELCEDTMTYKCPRITETEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLADYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKELAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGAAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGQNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKVSQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKYAVSRGTAKLRWFVERNLVKPEGKVIDLGCGRGGWSYYCAGLKKVTEVKGYTKGGPGHEEPIPMATYGWNLVKLHSGKDVFFVPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3550 - protein, 3292 aa, Artificial Sequence
  derived and/or modified protein sequence (wt) from DENV-1__JQ045634__SS-prME
SVTMLLMLMPTALAFHLTTRGGEPHMIVSKQERGKSLLFKTSAGVNMCTLIAMDLGELCEDTMTYKCPRITETEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLADYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKELAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGAAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGQNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKVSQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKYAVSRGTAKLRWFVERNLVKPEGKVIDLGCGRGGWAYYCAGLKKVTEVKGYTKGGPGHEEPIPMATYGWNLVKLHSGKDVFFVPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3551 - protein, 3292 aa, Artificial Sequence
  derived and/or modified protein sequence (wt) from DENV-1__JQ045636__SS-prME
SVTMLLMLMPTALAFHLTTRGGEPHMIVSKQERGKSLLFKTSAGVNMCTLIAMDLGEFCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTIATITPQAPSTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGATQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKLTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFFLLIMGQLTWNDLIRLCIMVGADASDRMGMGTTYLALMATFKMRPMFAVGLLFRRLTSREVLLLTIGLSLVASVELPNSLEELGDGLAMGIMILKLLTDFQSHQLWATLLSLTFIRTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAVVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTSEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFDPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKSIFKLTYQNKVVRVQRPAKNGTVMDVISRRDQRGSGQVGTYGLNTFTNMEAQLIRQMESEGIFSPSELETPNLAGRVLDWLEKHGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWGDVPYLGKREDQWCGSLIGLTARATWATNIQVAINQVRRLLGNENYLDYMTSMKRFKNESDPEGALW

SEQ ID NO: 3552 - protein, 3292 aa, Artificial Sequence
  derived and/or modified protein sequence (wt) from DENV-1__JQ045635__SS-prME
SVTMLLMLMPTALAFHLTTRGGEPHMIVSKQERGKSLLFKTSAGVNMCTLIAMDLGEFCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTIATITPQAPSTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGATQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKLTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFFLLIMGQLTWNDLIRLCIMVGADASDRMGMGTTYLALMATFKMRPMFAVGLLFRRLTSREVLLLTIGLSLVASVELPNSLEELGDGLAMGIMILKLLTDFQSHQLWATLLSLTFIRTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAVVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTSEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFDPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWAYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKSIFKLTYQNKVVRVQRPAKNGTVMDVISRRDQRGSGQVGTYGLNTFTNMEAQLIRQMESEGIFSPSELETPNLAGRVLDWLEKHGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWGDVPYLGKREDQWCGSLIGLTARATWATNIQVAINQVRRLLGNENYLDYMTSMKRFKNESDPEGALW

SEQ ID NO: 3553 - protein, 3292 aa, Artificial Sequence
  derived and/or modified protein sequence (wt) from DENV-1__JQ045637__SS-prME
SVTMLLMLMPTALAFHLTTRGGEPHMIVSKQERGKSLLFKTSAGVNMCTLIAMDLGELCEDTMTYKCPRITETEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQMSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGSRGPSLRTTTVTGKIIHEWCCRSCTLPPLRFRGEDGCWYGMEIRPVKEKEENLVKSMVSAGSGEVDSLSLGLLCISIMIEEVMRSRWSRKMLMTGTLAVFFLLIMGQLTWNDLIRLCIMVGANASDRMGMGTTYLALMAAFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAIEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLARSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3554 - protein, 3292 aa, Artificial Sequence
  derived and/or modified protein sequence (wt) from DENV-1__JQ045638__SS-prME
SVTMLLMLMPTALAFHLTTRGGEPHMIVSKQERGKSLLFKTSAGVNMCTLIAMDLGELCEDTMTYKCPRITETEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQMSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGSRGPSLRTTTVTGKIIHEWCCRSCTLPPLRFRGEDGCWYGMEIRPVKEKEENLVKSMVSAGSGEVDSLSLGLLCISIMIEEVMRSRWSRKMLMTGTLAVFFLLIMGQLTWNDLIRLCIMVGANASDRMGMGTTYLALMAAFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAIEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWAYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLARSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3555 - protein, 3292 aa, Artificial Sequence
  derived and/or modified protein sequence (wt) from DENV-1__JQ045639__SS-prME
SVTMFLMLMPTALAFHLTTRGGEPHMIVSKQERGKSLLFKTSAGVNMCTLIAMDLGELCEDTMTYKCPRITETEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKELAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWHFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQARASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSALLWMASVEPHWIAASIILEFFLMVLLIPEPDRQRTPQDNQLAYVVIGLLFMILTVAANEMGLLETTKKDLGIGHAAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGRCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWEDVPYLGKREDQWCGSLIGLTARATWATNIQVAINQVRRLIGNENYLDYMTSMKRFKNESDPEGALW

SEQ ID NO: 3556 - protein, 3292 aa, Artificial Sequence
  derived and/or modified protein sequence (wt) from DENV-1__JQ045641__SS-prME
SVTMLLMLMPTALAFHLTTRGGEPHMIVSKQERGKSLLFKTSAGVNMCTLIAMDLGELCEDTMTYKCPRITETEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKELAETQHGTVLVQIKYEGTDAPCKIPFSTQDEKGVAQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTLSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHTTFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3557 - protein, 3292 aa, Artificial Sequence
  derived and/or modified protein sequence (wt) from DENV-1__JQ045642__SS-prME
SVTMLLMLMPTALAFHLTTRGGEPHMIVSKQERGKSLLFKTSAGVNMCTLIAMDLGELCEDTMTYKCPRITETEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQCENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVGRAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3558 - protein, 3292 aa, Artificial Sequence
  derived and/or modified protein sequence (wt) from DENV-1__JQ045644__SS-prME
SVTMLLMLMPTALAFHLTTRGGEPHMIVSKQERGKSLLFKTSAGVNMCTLIAMDLGELCEDTMTYKCPRITETEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMAAFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLARSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3559 - protein, 3292 aa, Artificial Sequence
  derived and/or modified protein sequence (wt) from DENV-1__JQ045648__SS-prME
SVTMLLMLMPTALAFHLTTRGGEPHMIVSKQERGKSLLFKTSAGVNMCTLIAMDLGELCEDTMTYKCPRITETEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKELAETQHGTVLVQIKYEGTDAPCKIPFSTQDEKGVAQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTLSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHTTFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTTCTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3560 - protein, 3292 aa, Artificial Sequence
  derived and/or modified protein sequence (wt) from DENV-1__JQ045649__SS-prME
SVTMLLMLMPTALAFHLTTRGGEPHMIVSKQERGKSLLFKTSAGVNMCTLIAMDLGELCEDTMTYKCPRITETEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEHKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVREKEENLVKSMVSAGSGEVDSFSLGLLCISIMIEEVMRSRWSRKMLMTGTLAVFFLLIVGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWASLLSLTFIKTTFSLHYAWKTMAMVLSVVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLKNEARITDIMEPEHALLAKSIFKLTYQNKVVRVQRPAKNGTVMDVISRRDQRGSGQVGTYGLNTFTNMEAQLIRQMESEGIFSPSELETPNLAERVLHWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3561 - protein, 3292 aa, Artificial Sequence
  derived and/or modified protein sequence (wt) from DENV-1__JQ045650__SS-prME
SVTMLLMLMPTALAFHLTTRGGEPHMIVSKQERGKSLLFKTSAGVNMCTLIAMDLGELCEDTMTYKCPRITETEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKELAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEHKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVREKEENLVKSMVSAGSGEVDSFSLGLLCISIMIEEVMRSRWSRKMLMTGTLAVFFLLIVGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWASLLSLTFIKTTFSLHYAWKTMAMVLSVVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWAYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLKNEARITDIMEPEHALLAKSIFKLTYQNKVVRVQRPAKNGTVMDVISRRDQRGSGQVGTYGLNTFTNMEAQLIRQMESEGIFSPSELETPNLAERVLHWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3562 - protein, 3292 aa, Artificial Sequence
  derived and/or modified protein sequence (wt) from DENV-1__JQ045651__SS-prME
SVTMLLMLMPTALAFHLTTRGGEPHMIVSKQERGKSLLFKTSAGVNMCTLIAMDLGELCEDTMTYKCPRITETEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKELAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKYAVSRGTAKLRWFVERNLVKPEGKVIDLGCGRGGWSYYCAGLKKVTEVKGYTKGGPGHEEPIPMATYGWNLVKLHSGKDVFFVPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWEDVPYLGKREDQWCGSLIGLTARATWATNIQVAINQVRRLIGNENYLDYMTSMKRFKNESDPEGALW

SEQ ID NO: 3563 - protein, 3292 aa, Artificial Sequence
  derived and/or modified protein sequence (wt) from DENV-1__JQ045652__SS-prME
SVTMLLMLMPTALAFHLTTRGGEPHMIVSKQERGKSLLFKTSAGVNMCTLIAMDLGELCEDTMTYKCPRITETEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKELAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKYAVSRGTAKLRWFVERNLVKPEGKVIDLGCGRGGWSYYCAGLKKVTEVKGYTKGGPGHEEPIPMATYGWNLVKLHSGKDVFFVPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3564 - protein, 3292 aa, Artificial Sequence
  derived and/or modified protein sequence (wt) from DENV-1__JQ045653__SS-prME
SVTMLLMLMPTALAFHLTTRGGEPHMIVSKQERGKSLLFKTSAGVNMCTLIAMDLGELCEDTMTYKCPRITETEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTLVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKELAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPRSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSKKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHCAWKTMAMILSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQEDVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3565 - protein, 3292 aa, Artificial Sequence
  derived and/or modified protein sequence (wt) from DENV-1__JQ045657__SS-prME
SVTMLLMLMPTALAFHLTTRGGEPHMIVSKQERGKSLLFKTSAGVNMCTLIAMDLGEFCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPSTEIQLTDYGALTLDCSPRTGLDFNEMVLLTMKEKSWLVHKQWFLDLPLPWTSGASTSQETWNRKDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSTTRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTSEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAAENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFVPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEEIFSPSELETPNLAGRVLDWLEKHGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3566 - protein, 3292 aa, Artificial Sequence
  derived and/or modified protein sequence (wt) from DENV-1__JQ045659__SS-prME
SVTMLLMLMPTALAFHLTTRGGEPHMIVSKQERGKSLLFKTSAGVNMCTLIAMDLGELCEDTMTYKCPRITETEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGATQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVTGILAQGKKMIRPQPMEYKYSWKSWGKAKIIGADVQNTTFIIDGPNTPECPDDQRAWNIWEVEDYGFGIFTTNIWLKLRDSHTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVAVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASMELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEKEAEHSGASHNILVEVQDDGTMKIKDEERDDTLTILLKATLLAVSGVYPLSIPATLFVWYFWQKKKQRSGVLWDTPSPPEVGRAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKRPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3567 - protein, 3292 aa, Artificial Sequence
  derived and/or modified protein sequence (wt) from DENV-1__JQ045661__SS-prME
SVTMLLMLMPTALAFHLTTRGGEPHMIVSKQERGKSLLFKTSAGVNMCTLIAMDLGELCEDTMTYKCPRITETEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKELAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEHKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCTWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIVGQLTWNDLIRLCIMIGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSVVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKYAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3568 - protein, 3292 aa, Artificial Sequence
  derived and/or modified protein sequence (wt) from DENV-1__JQ045663__SS-prME
SVTMLLMLMPTALAFHLTTRGGEPHMIVSKQERGKSLLFKTSAGVNMCTLIAMDLGELCEDTMTYKCPRITETEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKELAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKLTVVVGDVAGILAQGKKMIRPQPMEYKYSWKSWGKAKIIGADVQNTTFIIDGPSTPECPDDQRAWNIWEVEDYGFGIFTTNIWLKLRDSHTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNSKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFLLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3569 - protein, 3292 aa, Artificial Sequence
  derived and/or modified protein sequence (wt) from DENV-1__JQ045665__SS-prME
SVTMLLMLMPTALAFHLTARGGEPHMIVSKQERGKSLLFKTSAGVNMCTLIAMDLGELCEDTMTYKCPRITETEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKELAETQHGTVLVQIKYEGTDAPCKIPFSTQDEKGATQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVNEHCGNRGPSLRTTTVTGKIIHEWCCRSCTLPPLRFRGEDGCWYGMEIRPVKEKEENLVKSMVSAGSGEVDSFSLGLLCISIMIEEVMRSRLSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHHAWKTMAMILSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKSFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRRHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTTCTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3570 - protein, 3292 aa, Artificial Sequence
  derived and/or modified protein sequence (wt) from DENV-1__JQ045666__SS-prME
SVTMLLMLMPTALAFHLTARGGEPHMIVSKQERGKSLLFKTSAGVNMCTLIAMDLGELCEDTMTYKCPRITETEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKELAETQHGTVLVQIKYEGTDAPCKIPFSTQDEKGATQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVNEHCGNRGPSLRTTTVTGKIIHEWCCRSCTLPPLRFRGEDGCWYGMEIRPVKEKEENLVKSMVSAGSGEVDSFSLGLLCISIMIEEVMRSRLSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHHAWKTMAMILSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKSFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRRHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3571 - protein, 3292 aa, Artificial Sequence
  derived and/or modified protein sequence (wt) from DENV-1__JQ045667__SS-prME
SVTMLLMLMPTALAFHLTTRGGEPHMIVSKQERGKSLLFKTSAGVNMCTLIAMDLGELCEDTMTYKCPRITETEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAILRKLCIEAKISNTTTNSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKGKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSYQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLMACYVISGSSADLSLEKAAEVSWEEEAEHSGASHNILVEVQGDGTMKIKDEERDDTLTILLKATLLAVSGVYPLSIPATLFVWYFWQKKKQRSGVLWDTPSPPEVGRAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNIYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTIQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3572 - protein, 3292 aa, Artificial Sequence
  derived and/or modified protein sequence (wt) from DENV-1__KU094071__SS-prME
SVTMLLMLLPTALAFHLTTRGGEPHMIVSKQERGKSLLFKTSAGVNMCTLIAMDLGELCEDTMTYKCPRITKAEPDDVDCWCNATDTWVTYGTCSQTGEHRRDKRSVALAPHVGLGLETRAETWMSSEGAWKQIQKVETWALRHPGFTVIALFLAHAIGTSITQKGIIFILLMLVTPSMAMRCVGIGNRDFVEGLSGGTWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNETTEHGTIATITPQAPTSEIQLTDYGALTLDCSPRTGLDFNEMVLLTMKRKSWLVHKQWFLDLPLPWTSGASTPQETWNREDLLVTFKTAHAKKQEVVVLGSQEGAMHTALTGATEIQTSGTTKIFAGHLKCRLKMDKLTLKGMSYVMCTGSFKLEKEVAETQHGTVLVQVKYEGTDAPCKIPFSTQDEKGVTQNGRLITANPIVTDKEKPVNIEAEPPFGESYIVVGAGEKALKLSWFKKGSSIGKMLEATARGARRMAILGDTAWDFGSIGGVFTSVGKLVHQIFGTAYGVLFSGVSWTMKIGIGILLTWLGLNSRSASLSMTCIAVGMVTLYLGVMVQADSGCVINWKGRELKCGSGIFVTNEVHTWTEQYKFRADSPKRLSAAIGKAWEEGVCGIRSATRLENIMWKQISNELNHILLENDMKFTVVVGDVSGILTQGRKMIGPQPMEHKYSWKSWGKAKIIGADVQNTTFIIDGPNTPECPDDQRAWNIWEVEDYGFGIFTTNIWLKLRDSYTQVCDPRLMSAAIKDSKAVHADMGYWIESEKNETWRLARASFIEVKTCVWPKSHTLWSNGVLESEMIIPKIYGGPISQHNYRPGYSTQTAGPWHLGKLELDFDLCEGTTVVVDEHCGNRGPSLRTTTVTGKIIHEWCCRSCTLPPLRFKGEDGCWYGMEIRPVKDKEENLVKSLVSAGSGEVDSFSLGLLCVSIMIEEVMRSRWSRKMLMTGTLAVFLLLIMGQLTWNDLIRLCIMVGANASDRMGMGTTYLALIATFKMRPMFAVGLLFRRLTSREVLLLTIGLSLVASVELPNSLEELGDGLAMGIMILKLLTDFQSHQLWAALLSLTFIKTTFSLHYAWKTMAMVLSTVSLFPLCLSTTSRKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPISIPATLFVWYFRQKKKQRSGVLWDTPSPPEVERAVLDDGIYRILQRGLLGRSQVGVGVFQEGVFHTMWHVTRGAVLMYQGKRLEPSWASVKKDLISYGGGWRFQGSWNTGEEVQVIAVEPGKNPKNVQTAPGTFKTPEGEVGVIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCSKPVILKDGPERVILAGPMPVTVASAAQRRGRIGRNQNKEGDQYIYMGQPLNNDEDHAHWTEAKMLLDNINTPEGIIPALFEPERGKSAAIDGEYRLRGEARKTFVELMRRGDLPVWLSYKVASEGFQYSDRKWCFDGERNNQVLEENMDVEIWTKEGERKKLRPRWLDARTYSDPQALREFKEFAAGRRSVSGDLILEIGKLPQHLTQRAQNALDNLVMLHNSEQGGKAYRHAMEELPDTIETLMLLALIAVLTGGVTLFFLSGRGLGKTSIGLLCVMASSVLLWVASVEPHWIAASIILEFFLMVLLIPEPDRQRTPQDNQLAYVVIGLLFMILTVAANEMGLLETTKKDLGIGHVAVENHHHATMLDVDLRPASAWTLYAVATTIITPMMRHTIENTTANISLTAIANQAAILMGLDKGWPISKMDIGVPLLALGCYSQVNPPTLIAAVLMLVAHYAIIGPGLQAKATREAQKRTAAGIMKNPTVDGIVAIDLDPVVYDAKFEKQLGQIMLLILCTSQILSMRTTWALCESITLATGPLTTLWEGSPGKFWNTTIAVSMANIFRGSYLAGAGLAFPLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEVQLIRQMESEGIFSPSELETPNLAERVLDWLEKHGVERLKRMAISGDDCVVKPTDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPIDWVPTSRTTWSIHAHHQWMTTEDMLSVWNRVWIEENPWMEDKTHVSSWEDVPYLGKREDQWCGSLIGLTARATWATNIQVAINQVRRLIGNENYLDYMTSMKRFKDESDLEGALW

SEQ ID NO: 3573 - protein, 3292 aa, Artificial Sequence
  derived and/or modified protein sequence (wt) from DENV-1__HQ624983__SS-prME
SVTMLLMLVPTALAFHLTTRGGEPHMIVSKQERGKSLLFKTSAGVNMCTLIAMDLGEFCEDTMTYKCPRISEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPSTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGMTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTSEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNHLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFVPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKISGGNMYADDTAGWDTRITEDDLQNEAKITDIMEPEHALLANSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTAEDMLSVWNRVWIEENPWMEDKTHISSWEDVPYLGKREDQWCGSLIGLTARATWATNIQVAINQVRRLIGNENYLDYMTSMKRFKNESDPEGALW

SEQ ID NO: 3574 - protein, 3292 aa, Artificial Sequence
  derived and/or modified protein sequence (wt) from DENV-1__FJ384655__SS-prME
SVTMLLMLLPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQKVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGTSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNTTFIIDGPDTPECPDEQRAWNIWEVEDYGFGIFTTNIWLKLRDSYTQMCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCVSIMIEEVMRSRWSRKMLMTGTLAVFLLLIMGQLTWNDLIRLCIMVGANASDKMGMGTTYLALMATFKMRPMFAVGLLFRRLASREVLLLTIGLSLVASVELPNSLEELGDGLAMGIMMLKLLTEFQPHHLWTTLLSLTFIKTTLSLDYAWKTTAMVLSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEEEAEHSGTSHNILVEVQDDGAMKIKDEERDDTLTILLKATLLAVSGVYPMSIPATLFVWYFWQKKKQRSGVLWDTPSPPEVEGAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVSREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGGYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGHVAAENHQHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPVPMATYGWNLVKLHSGKDVFFMPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEVQLIRQMESEGIFLPSELETPNLAERVLDWLEKHGAERLKRMAISGDDCVVKPIDDRFATALIALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 3575 - protein, 3292 aa, Artificial Sequence
  derived and/or modified protein sequence (wt) from DENV-1__KC759167__SS-prME
SVTMLLMLMPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSVTQKGIIFILLMLVTPSMAMRCVGIGSRDFVEGLSGATWVDVVLEHGSCVTTMAKDKPTLDIELLKTEVTNPAILRKLCIEAKISNTTTDSRCPTQGEAPEVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAKPPFGESCIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTPPPLRFRGEDGCWYGMEIRPVKEKEENLVKSMVSAGSGEVDSFSLGLLCISIMIEEVMRSRWSRKMLMTGALAVFLLLIMGQLTWNDLIRLCIMVGANASDRMGMGTTYLALMATFKMRPMFAVGLLFRKLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWRKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEGVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEYTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTYVELMRRGDLPVWLSYKVASEGFQYSDRRWYFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVGNHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKLEFNSYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSSSSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEEIFSPSELETPNLAERVLDWLEKYGIERLKRMAISGDDCVVKPIDNRFATALTALNDMGKVRKDIPQWEPSKGWNDWQQVPLCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3576 - protein, 3292 aa, Artificial Sequence
  derived and/or modified protein sequence (wt) from DENV-1__JQ048541__SS-prME
SVTMLLMLMPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFLTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEHKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHKLRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRSCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHATMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLYSGKDVFFMPPEKCDTLLCDIGESSPNPTIEEGRTLRVLKMVEPWLRGNQFCIKVLNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFIDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKAIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWGLRETACLGKSYAQMWQLMYFHRRDLRLAANAICSAVPVDWVPTSRTTWSIHAHHQWMTTEDMLSVWNRVWIEENPWMEDKTHISSWEDVPYLGKREDQWCGSLIGLTARATWATNIQVAINQVRRLIGNENYLDYMTSMKRFKNESDPEGALW

SEQ ID NO: 3577 - protein, 3292 aa, Artificial Sequence
  derived and/or modified protein sequence (wt) from DENV-1__JN697056__SS-prME
SVTMLLMLLPTALTFHLTTRGGEPHMIVSKQERGKSLLFKTSAGVNMCTLIAMDLGELCDDTMTYKCPRITETEPDDVDCWCNATETWVTYGTCSQTGEHRRDKRSVALAPHIGLGLETRTETWMSSEGAWRQIQKVETWALRHPGFTVIALFLAHAIGTSITQKGIIFILLMLVTPSMAMRCVGIGNRDFVEGLSGATWVDVVLEHGSCVTTMAKDKPTLDIELLKTEVTNPAVLRKLCIEAKISNTTTDSRCPTQGEATLVEEQDTNFVCRRTFVDRGWGNGCGLFGKGSLITCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGISYVMCTGPFKLEKEVAETQHGTVLVQVKYEGTDAPCKIPFSSQDEKGVTQNGRLVTANPIVTDKEKPVNIEAEPPFGESYIVVGAGEKALKLSWFKKGSSIGKMFEATARGARRMAILGDTAWDFGSIGGVFTSVGKLVHQIFGTAYGVLFSGVSWTMKIGIGILLTWLGLNSRSTSLSMTCIAVGMITLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVSGILAQGKKSIRPQPMEHKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSKKMLMTGTLAVFLLLTMGQLTWNDLIRLCIMVGANASDNMGMGTTYLALMATFRMRPMFAVGLLFRRLTSREVLLLTVGLSLVASVELPNSLEELGDGLAMGIMILKLLTDFQSHQLWATLLSLTFVKTTFSLHYAWKTMAMILSIVSLLPLCLSTTSQKTTWLPVLLGSLGCKPLTMFLITENKIWGRKSWPLNEGIMAVGIVSILLSSLLKNDVPLAGPLIAGGMLIACYVISGSSADLSLEKAAEVSWEEEAEHSGASHNILVEIQDDGTMKIKDEERDDTITILLKATLLAISGVYPMSIPATLFVWYFWQKRKQRSGVLWDTPSPPEVERAVLDDGIYRILQRGLLGRSQVGVGVFQEGVFHTMWHVTRGAVLMYQGKRLEPSWASVKKDLISYGGGWRFQGSWNTGEEVQVIAVEPGKNPKNVQTAPGTFKTSEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLVLAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVILDEEKDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGKAYRHAMEELPDTIETLMLLALIAVLTGGVTLFFLSGRGLGKTSIGLLCVMSSSALLWMASVEPHWIAASIILEFFLMVLLIPEPDRQRTPQDNQLAYVVIGLLFMILTVAANEMGLLETTKKDLGIGHAAAENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNIYKRSGIVEVDRSEAKEGLKRGETTKHAVSRGTAKLRWFVERNLVKPEGKVIDLGCGRGGWSYYCAGLKKVTEVKGYTKGGPGHEEPIPMATYGWNLVKLYSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVRRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMGAQLIRQMESEGIFLPSELETPNLAGRVLDWLEKHGIERLRRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEDVPYLGKREDQWCGSLIGLTARATWATNIQVAINQVRRLIGNENYLDYMTSMKRFKNESDPEGALW

SEQ ID NO: 3578 - protein, 3292 aa, Artificial Sequence
  derived and/or modified protein sequence (wt) from DENV-1__JN697057__SS-prME
SVTMLLMLMPTALAFHLTTRGGEPHMIVSKQERGKSLLFKTSAGVNICTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKVSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEHKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWVTLLSLTFIKTAFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNRERKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLAAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVVDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPKHALLAKAIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWEDVPYLGKREDQWCGSLIGLTARATWATNIQVAINQVRRLIGNENYLDYMTSMKRFKNESDPEGALW

SEQ ID NO: 3579 - protein, 3292 aa, Artificial Sequence
  derived and/or modified protein sequence (wt) from DENV-1__HQ624984__SS-prME
SVTMLLMLMPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSESAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAILRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTSEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNALIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVGNHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGITEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3580 - protein, 3292 aa, Artificial Sequence
  derived and/or modified protein sequence (wt) from DENV-1__HQ891314__SS-prME
SVTMLLMLMPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNESTEHGTTATITPQAPTTEIQLTDYGALTLDCSPRTGLDFTEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEHKYSWKNWGKAKIIGADVQNSTFIIDGPNTPECSDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSMTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPKVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKMRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKAGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGKGLGKTSIGLLCVMASSALLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTIDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWSFLSRNKKPRICTREEFTRKVRSNAAIGAVFVDENQWNSAKEAVEDDRFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKSIFKLTYQNKVVRVQRPAKNGTVMDVISRRDQRGSGQVGTYGLNTFTNMEAQLIRQMESEEIFSPNELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTRVSSWEDVPYLGKREDQWCGSLIGLTARATWATNIQVAINQVRRLIGNENYSDYMTSMKRFKNESEPEGALW

SEQ ID NO: 3581 - protein, 3292 aa, Artificial Sequence
  derived and/or modified protein sequence (wt) from DENV-1__HQ891315__SS-prME
SVTMLLMLMPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEHKYSWKNWGKAKIIGADVQNSTFIIDGPNTPECSDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSIVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSMTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPKVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKMRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKAGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGKGLGKTSIGLLCVMASSALLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTIDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWSFLSRNKKPRICTREEFTRKVRSNAAIGAVFVDENQWNSAKEAVEDDRFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKSIFKLTYQNKVVRVQRPAKNGTVMDVISRRDQRGSGQVGTYGLNTFTNMEAQLIRQMESEEIFSPNELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTRVSSWEDVPYLGKREDQWCGSLIGLTARATWATNIQVAINQVRRLIGNENYSDYMTSMKRFKNESEPEGALW

SEQ ID NO: 3582 - protein, 3292 aa, Artificial Sequence
  derived and/or modified protein sequence (wt) from DENV-1__HQ891316__SS-prME
SVTMLLMLMPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEHKYSWKNWGKAKIIGADVQNSTFIIDGPNTPECSDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSMTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPKVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKMRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKAGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGKGLGKTSIGLLCVMASSALLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTIDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWSFLSRNKKPRICTREEFTRKVRSNAAIGAVFVDENQWNSAKEAVEDDRFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKSIFKLTYQNKVVRVQRPAKNGTVMDVISRRDQRGSGQVGTYGLNTFTNMEAQLIRQMESEEIFSPNELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTRVSSWEDVPYLGKREDQWCGSLIGLTARATWATNIQVAINQVRRLIGNENYSDYMTSMKRFKNESEPEGALW

SEQ ID NO: 3583 - protein, 3292 aa, Artificial Sequence
  derived and/or modified protein sequence (wt) from DENV-1__JN054256__SS-prME
SVTMLLMLMPTALAFHLTTREGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNESTEHGTTATITPQAPTTEIQLTDYGALTLDCSPRTGLDFTEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKLTVVVGDVAGILAQGKKMIRPQPMEHKYSWKNWGKAKIIGADVQNSTFIIDGPNTPECSDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLIDFQSHQLWATLLSMTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPKVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKMRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKAGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGKGLGKTSIGLLCVMASSALLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTIDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWSFLSRNKKPRICTREEFTRKVRSNAAIGAVFVDENQWNSAKEAVEDDRFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKSIFKLTYQNKVVRVQRPAKNGTVMDVISRRDQRGSGQVGTYGLNTFTNMEAQLIRQMESEEIFSPNELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTRVSSWEDVPYLGKREDQWCGSLIGLTARATWATNIQVAINQVRRLIGNENYSDYMTSMKRFKNESEPEGALW

SEQ ID NO: 3584 - protein, 3292 aa, Artificial Sequence
  derived and/or modified protein sequence (wt) from DENV-1__JN054255__SS-prME
SVTMLLMLMPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQMSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEHKYSWKNWGKAKIIGADVQNSTFIIDGPNTPECSDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSMTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPKVEKAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSGIAQAKASQEGPLPEIEDEVFRKRNLTIMDLHPGSGKTRRYLPAIVREAIKRKMRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKAGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDENHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGKGLGKTSIGLLCVMASSALLWMASVEPHWIAASIILEFFLMVLLIPEPDRQRTPQDNQLAYVVIGLLFMILTVAANEMGLLETTKKDLGIGHVAVENHHHAAMLDIDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTIDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGMVKLLTKPWDVIPMVTQIAMTDTTPFGQQRVFKEKVDTRTPKAKRGTAQIMEVTARWLWSFLSRNKKPRICTREEFTRKVRSNAAIGAVFVDENQWNSAKEAVEDDRFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKSIFKLTYQNKVVRVQRPSKNGTVMDVISRRDQRGSGQVGTYGLNTFTNMEAQLIRQMESEEIFSPNELETPNLAKRVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTRVSSWEDVPYLGKREDQWCGSLIGLTARATWATNIQVAINQVRRLIGNENYSDYMTSMKRFKNESEPEGALW

SEQ ID NO: 3585 - protein, 3292 aa, Artificial Sequence
  derived and/or modified protein sequence (wt) from DENV-1__KP406801__SS-prME
SVTMLLMLLPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWRQIQKVETWALRHPGFTVIALFLAHTIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALAGATEIQMSGTTTIFAGHLKCRLKMDKLTLKGVSYVMCTGSFKLEKEVAETQHGTVLVQVKYEGTDAPCKIPFSIQDEKGVTQNGRLITANPIATDKEKPVNIETEPPFGESYIVIGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILTQGKKMIRPQPMEHKYSWKSWGKAKIIGADTQNTTFIIDGPDTPECPDDQRAWNIWEVEDYGFGIFTTNIWLKLRDSYTQMCDHRLMSAAIKDSKAVHADMGYWIESEKNETWKLARASFIEVKTCIWPRSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVRSMVSAGSGEVDSFSLGLLCVSIMIEEVMRSRWSRKMLMTGTLAVFFLLIMGQLTWNDLIRLCIMVGANVSDRMGMGTTYLALMATFKMRPMFAVGLLFRRLTSREVLLLTIGLSLVASVELPNSLEELGDGLAMGIMMLKLLTDFQSHQLWTTLLSLTFIKTTLSLDYAWKTIAMVLSIVSLFPLCLSTTSQKTTWLPVLLGSFGCKPLTMFLITENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVMASSVLLWMASVEPHWIAASIILEFFLMVLLIPEPDRQRTPQDNQLAYVVIGLLFMILTVAANEMGLLETTKKDLGIGHVVAENHHHATMLDIDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVRPEGKVIDLGCGRGGWSYYCAGLKKVTEVKGYTKGGPGHEEPIPMATYGWNLVKLYSGKDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEIANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRPKRGTAQIMEVTAKWLWGFLSRNKKPRICTREEFTRKVRSNAAIGAVFVDENQWNSAKEAVEDEKFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKSGTVMDVISRRDQRGSGQVGTYGLNTFTNMEVQLIRQMESEGIFSPSELENSNLAERVLDWLEKHGVERLKRMAISGDDCVVKPTDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEDVPYLGKREDQWCGSLIGLTARATWATNIQVAINQVRRLIGNENYLDYMTSMKRFKNESDPEGALW

SEQ ID NO: 3586 - protein, 3292 aa, Artificial Sequence
  derived and/or modified protein sequence (wt) from DENV-1__KP406802__SS-prME
SVTMLLMLMPTALAFHLTTRGGEPHMIVSKQERGKSLLFKTSAGINMCTLIAMDLGELCEDTLTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQEIWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEHKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRVGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTTQIMEVTARWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKAIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWEDVPYLGKREDQWCGSLIGLTARATWATNIQVAINQVRRLIGNENYLDYMTSMKRFKNESDPEGALW

SEQ ID NO: 3587 - protein, 3292 aa, Artificial Sequence
  derived and/or modified protein sequence (wt) from DENV-1__KP406803__SS-prME
SVTMLLMLLPTALAFHLTTRGGEPHMIVSKQERGKSLLFKTSAGVNMCTLIAMDLGELCEDTMTYKCPRITETEPDDVDCWCNATETWVTYGTCSQTGEHRRDKRSVALAPHVGLGLETRTETWMSSEGAWRQIQKVETWALRHPGFTVIALFLAHAIGTSITQKGIIFILLMLVTPSMAMRCVGIGNRDFVEGLSGATWVDVVLEHGSCVTTMAKDKPTLDIELLKTEVTNPAVLRKLCIEAKISNTTTDSRCPTQGEATLVEEQDTNFVCRRTFVDRGWGNGCGLFGKGSLITCAKFKCVTKLEGKIVQYENLKYSVIVTVHTGDQHQVGNETTEHGTTATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGVSYVMCTGSFKLEKEVAETQHGTVLVQVKYEGTDAPCKIPFSSQDEKGVTQNGRLITANPIVTDKEKPVNIEAEPPFGESYLVVGAGEKALKLSWFKKGSSIGKMFEATARGARRMAILGDTAWDFGSIGGVFTSVGKLIHQIFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVNGILAQGKKMIRPQPMEHKYSWKSWGKAKVIGADVQNITFIIDGPNTPECPDDQRAWNIWEVEDYGFGIFTTNIWLKLRDSYTQVCDHRLMSAAIKDSKAVHADMGYWIESEKNETWKLTRASFIEVKTCVWPKSHTLWSNGVLESEMIIPKIYGGPISQHNYRPGYFTQTAGPWHLGKLELDFGLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFLLLIMGQLTWNDLIRLCIMVGANASDKMGMGTTYLALMATFRMRPMFAVGLLFRRLTSREVLLLTVGLSLVASVELPNSLEELGDGLAMGIMMLKLLTDFQSHQLWAALLSLTFVKTTFSLHYAWKTMAMILSIVSLFPLCLSTTSQKTTWLPVLLGSLGCKPLTMFLITENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAISGVYPMSIPATLFVWYFWQKKKQRSGVLWDTPSPPEVERAVLDDGIYRILQRGLLGKSQVGVGVFQEGVFHTMWHVTRGAVLMYQGKRLEPSWASVKKDLISYGGGWRFQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLVLAPTRVVASEMAEALKGIPIRYQTTAVKSEHTGKEIVDLMCHATFTMRLLSPVRVPNYNMIIMDEAHFTDPASIAARGYISTRVGMGEAAAIFMTATPPGSMEAFPQSNAAIQDEERDIPERSWNSGYDWITDFPGKTVWFVPSIKSGNDIANCLRKNGKRVVQLSRKTFDTEYQKTKNNDWDYVVTTDISEMGANFRADRVIDPRRCLKPVILKDGPERVILAGPMPVTVASAAQRRGRIGRNQNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGKAYRHAMEELPDTIETLMLLALIAVLTGGVTLFFLSGRGLGKTSIGLLCVMASSALLWMASVEPHWIAASIILEFFLMVLLIPEPDRQRTPQDNQLAYVVIGLLFMILTVAANEMGLLETTKKDLGIGHVAAESHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIIEVDRSEAKEGLKRGETTKHAVSRGTAKLRWFVERNLVKPEGKVIDLGCGRGGWSYYCAGLKKVTEVKGYTKGGPGHEEPIPMATYGWNLVKLYSGKDVFFTPPEKCDTLLCDIGESSPNPTIEEGRTLRVLRMVEPWLRGNQFCIKVLNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEAQLIRQMESEGIFLPSELETPNLAERVLDWLEKYGIERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEDVPYLGKREDQWCGSLIGLTARATWATNIQVAINQVRRLIGNENYLDYMTSMKRFKNESDPEGALW

SEQ ID NO: 3588 - protein, 3292 aa, Artificial Sequence
  derived and/or modified protein sequence (wt) from DENV-1__KJ438293__SS-prME
SVTMLLMLMPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAILRKLCIEAKISNTTTDSRCPTQGEATLVEEQDANFVCRRTFVDRGWGNGCGLFGKGSLMTCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKISWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTGFQSHQLWATLLSLTFIKTTFSLHYAWKTMAMVLSIVSLFPLCLSTTSQKTTWLPVLLGSLGCKPLTMFLITENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVVLAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWIASVEPHWIAASIILEFFLMVLLIPEPDRQRTPQDNQLAYVVIGLLFMILTVAANEMGLLETTKKDLGIGHVAVENHHHAAILDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLYSGKDVFFIPPEKCDTLLCDIGESSPNPTIEEGRTLRVLKMVEPWLRGNQFCIKILNPYMPSVVETLEQMQRKHGGMLVRNPLSRNSTHEMYWISCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKAIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWEDVPYLGKREDQWCGSLIGLTARATWATNIQVAINQVRRLIGNENYLDYMTSMKRFKNESDPEGALW

SEQ ID NO: 3589 - protein, 3292 aa, Artificial Sequence
  derived and/or modified protein sequence (wt) from DENV-1__KJ438296__SS-prME
SVTMLLMLMPTALAFHLTTRGGEPHMMVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMIGTLAVFFLLIMGQLTWNDLIRLCIMVGANASDRMGMGTTYLALMATFKMRPMFAVGLLFRRLTSREVLLLTIGLSLVASAELPNSLEELGDGLAMGIMILKLLTDFQSHQLWATLLSLTFIKTTFSLHYAWKTMAMVLSIVSLIPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVFPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRRLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFIDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKAIFKLTYQNKVVRVQRPAKNGTVMDVISRRDQRGSGQVGTYGLNTFTNMEAQLIRQMESEGIFSPSELETPNLAERVLDWLGKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISNWEDVPYLGKREDQWCGSLIGLTARATWATNIQVAINQVRRLIGNENYLDYMTSMKRFKNESDPEGALW

SEQ ID NO: 3590 - protein, 3292 aa, Artificial Sequence
  derived and/or modified protein sequence (wt) from DENV-1__KC692495__SS-prME
SVTMLLMLLPTALAFHLTTRGGEPHMIVSKQERGKSLLFKTSAGVNMCTLIAMDLGELCEDTMTYKCPRITEAEPDDVDCWCNATDTWVTYGTCSQTGEHRREKRSVALAPHVGLGLETRTETWMSSEGAWKQIQRVETWALRHPGFTVIAFFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKRGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNTTFIIDGPDTPECPDGQRAWNIWEVEDYGFGVFTTNIWLKLRDSYTQMCDHRLMSAAIKDSKAVHADMGYWIESEKNETWKLARASFIEVKTCTWPKSHTLWSNGVLESEMIIPKIFGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCVSIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMMLKLLTEFQPHQLWTTLLSLTFVKTTLSLDYAWKTTAMVLSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEQEAEHSGASHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGYVAAENHQHATMLDVDLHPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEVQLIRQMESEGIFLPSELETPNLAERALDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPASRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 3591 - protein, 3292 aa, Artificial Sequence
  derived and/or modified protein sequence (wt) from DENV-1__KC692496__SS-prME
SVTMLLMLLPTALAFHLTTRGGEPHMIVSKQERGKSLLFKTSAGVNMCTLIAMDLGELCEDTMTYKCPRITEAEPDDVDCWCNATDTWVTYGTCSQTGEHRREKRSVALAPHVGLGLETRTETWMSSEGAWRQIQRVETWALRHPGFTVIAFFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKRGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNTTFIIDGPDTPECPDGQRAWNIWEVEDYGFGVFTTNIWLKLRDSYTQMCDHRLMSAAIKDSKAVHADMGYWIESEKNETWKLARASFIEVKTCTWPKSHTLWSNGVLESEMIIPKIFGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCVSIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMMLKLLTEFQPHQLWTTLLSLTFVKTTLSLDYAWKTTAMVLSIVSLFPLCLSTTSQKTTWLPVLLGSFGCKPLTMFLITENKIWGRKSWPLNEGIMAIGIVSILLSSLLKNDVPLAGPLLAGGMLIACYVISGSSADLSLEKAAEVSWEQEAEHSGASHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGYVAAENHQHATMLDVDLHPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEVQLIRQMESEGIFLPSELETPNLAERALDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPASRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 3592 - protein, 3292 aa, Artificial Sequence
  derived and/or modified protein sequence (wt) from DENV-1__KC692497__SS-prME
SVTMLLMLLPTALAFHLTTRGGEPHMIVSKQERGKSLLFKTSAGVNMCTLIAMDLGELCEDTMTYKCPRITEAEPDDVDCWCNATDTWVTYGTCSQTGEHRREKRSVALAPHVGLGLETRTETWMSSEGAWKQIQRVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKRGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNTTFIIDGPDTPECPDGQRAWNIWEVEDYGFGVFTTNIWLKLRDSYTQMCDHRLMSAAIKDSKAVHADMGYWIESEKNETWKLARASFIEVKTCTWPKSHTLWSNGVLESEMIIPKIFGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCVSIMIEEVMRSRWSRKMLMTGTLAVFLLLIMGQLTWNDLIRLCIMVGANASDRMGTGTTYLALMATFKMRPMFAVGLLFRRLTSREVLLLTIGLSLVASVELPNSLEELGDGLAMGIMMLKLLTEFQPHQLWTTLLSLTFVKTTLSLDYAWKTTAMVLSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEQEAEHSGASHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGYVAAENHQHATMLDVDLHPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDVIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEVQLIRQMESEGIFLPSELETPNLAERALDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPASRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 3593 - protein, 3292 aa, Artificial Sequence
  derived and/or modified protein sequence (wt) from DENV-1__KC692498__SS-prME
SVTMLLMLLPTALAFHLTTRGGEPHMIVSKQERGKSLLFKTSAGVNMCTLIAMDLGELCEDTMTYKCPRITEAEPDDVDCWCNATDTWVTYGTCSQTGEHRREKRSVALAPHVGLGLETRTETWMSSEGAWKQIQRVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKRGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNTTFIIDGPDTPECPDGQRAWNIWEVEDYGFGVFTTNIWLKLRDSYTQMCDHRLMSAAIKDSKAVHADMGYWIESEKNETWKLARASFIEVKTCTWPKSHTLWSNGVLESEMIIPKIFGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCVSIMIEEVMRSRWSRKMLMTGTLAVFLLLIMGQLTWNDLIRLCIMVGANASDRMGTGTTYLALMATFKMRPMFAVGLLFRRLTSREVLLLTIGLSLVASVELPNSLEELGDGLAMGIMMLKLLTEFQPHQLWTTLLSLTFVKTTLSLDYAWKTTAMVLSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEQEAEHSGASHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFSGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGYVAAENHQHATMLDVDLHPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDVIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEVQLIRQMESEGIFLPSELETPNLAERALDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPASRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 3594 - protein, 3292 aa, Artificial Sequence
  derived and/or modified protein sequence (wt) from DENV-1__KC692499__SS-prME
SVTMLLMLLPTALAFHLTTRGGEPHMIVSKQERGKSLLFKTSAGVNMCTLIAMDLGELCEDTMTYKCPRITEAEPDDVDCWCNATDTWVTYGTCSQTGEHRREKRSVALAPHVGLGLETRTETWMSSEGAWKQIQRVETWALRHPGFTVIAFFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDVNFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKRGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEYKYSWKSWGKAKIIGADIQNTTFIIDGPDTPECPDGQRAWNIWEVEDYGFGVFTTNIWLKLRDSYTQMCDHRLMSAAIKDSKAVHADMGYWIESEKNETWKLARASFIEVKTCTWPKSHTLWSNGVLESEMIIPKIFGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCVSIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMMLKLLTEFQPHQLWTTLLSLTFVKTTLSLDYAWKTTAMVLSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEQEAEHSGASHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWIADFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGYVAAENHQHATMLDVDLHPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEVQLIRQMESEGIFLPSELETPNLAERALDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPASRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 3595 - protein, 3292 aa, Artificial Sequence
  derived and/or modified protein sequence (wt) from DENV-1__KC692500__SS-prME
SVTMLLMLLPTALAFHLTTRGGEPHMIVSKQERGKSLLFKTSAGVNMCTLIAMDLGELCEDTMTYKCPRITEAEPDDVDCWCNATDTWVTYGTCSQTGEHRREKRSVALAPHVGLGLETRTETWMSSEGAWKQIQRVETWALRHPGFTVIAFFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKGKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKRGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNTTFIIDGPDTPECPDGQRAWNIWEVEDYGFGVFTTNIWLKLRDSYTQMCDHRLMSAAIKDSKAVHADMGYWIESEKNETWKLARASFIEVKTCTWPKSHTLWSNGVLESEMIIPKIFGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCVSIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMMLKLLTEFQPHQLWTTLLSLTFVKTTLSLDYAWKTTAMVLSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEQEAEHSGASHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFKGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGYVAAENHQHATMLDVDLHPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEVQLIRQMESEGIFLPSELETPNLAERALDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPASRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 3596 - protein, 3292 aa, Artificial Sequence
  derived and/or modified protein sequence (wt) from DENV-1__KC692501__SS-prME
SVTMLLMLLPTALAFHLTTRGGEPHMIVSKQERGKSLLFKTSAGVNMCTLIAMDLGELCEDTMTYKCPRITEAEPDDVDCWCNATDTWVTYGTCSQTGEHRREKRSVALAPHVGLGLETRTETWMSSEGAWKQIQRVETWALRHPGFTVIAFFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKRGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNTTFIIDGPDTPECPDGQRAWNIWEVEDYGFGVFTTNIWLKLRDSYTQMCDHRLMSAAIKDSKAVHADMGYWIESEKNETWKLARASFIEVKTCTWPKSHTLWSNGVLESEMIIPKIFGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCVSIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMMLKLLTEFQPHQLWTTLLSLTFVKTTLSLDYAWKTTAMVLSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEQEAEHSGASHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREEKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGYVAAENHQHATMLDVDLHPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEVQLIRQMESEGIFLPSELETPNLAERALDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPASRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 3597 - protein, 3292 aa, Artificial Sequence
  derived and/or modified protein sequence (wt) from DENV-1__KC692502__SS-prME
SVTMLLMLLPTALAFHLTTRGGEPHMIVSKQERGKSLLFKTSAGVNMCTLIAMDLGELCEDTMTYKCPRITEAEPDDVDCWCNATDTWVTYGTCSQTGEHRREKRSVALAPHVGLGLETRTETWMSSEGAWKQIQRVETWALRHPGFTVIAFFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGVSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKRGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNTTFIIDGPDTPECPDGQRAWNIWEVEDYGFGVFTTNIWLKLRDSYTQMCDHRLMSAAIKDSKAVHADMGYWIESEKNETWKLARASFIEVKTCTWPKSHTLWSNGVLESEMIIPKIFGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCVSIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMMLKLLTEFQPHQLWTTLLSLTFVRTTLSLDYAWKTTAMVLSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEQEAEHSGASHNILVEVQDDGTMKIKDEERDDTLTILLKATLLAVSGVYPMSIPATLFVWYFWQKKKQRSGVLWDTPSPPEMERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGYVAAENHQHATMLDVDLHPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAMSIFKLTYQNKVVRVQRPAKNGTVMDVISRRDQRGSGQVGTYGLNTFTNMEVQLIRQMESEGIFLPSELETPNLAERALDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPASRTTWSIHAHHQWMTTEDMLSVWNRVWIEENPWMEDKTHVSSWEEVPYLGKREDQWCGSLIGLTARATWATNIQVAISQVRRLIGNENYLDYMTSMKRFKNESDPEGALW

SEQ ID NO: 3598 - protein, 3292 aa, Artificial Sequence
  derived and/or modified protein sequence (wt) from DENV-1__KC692503__SS-prME
SVTMLLMLLPTALAFHLTTRGGEPHMIVSKQERGKSLLFKTSAGVNMCTLIAMDLGELCEDTMTYKCPRITEAEPDDVDCWCNATDTWVTYGTCSQTGEHRREKRSVALAPHVGLGLETRTETWMSSEGAWKQIQRVETWALRHPGFTVIAFFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDRLTLKGMSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKRGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNTTFIIDGPDTPECPDGQRAWNIWEVEDYGFGVFTTNIWLKLRDSYTQICDHRLMSAAIKDSKAVHADMGYWIESEKNETWKLARASFIEVKTCTWPKSHTLWSNGVLESEMIIPKIFGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCVSIMIEEVMRSRWSRKMLMIGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMMLKLLTEFQPHQLWTTLLSLTFVKTTLSLDYAWKTTAMVLSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEQEAEHSGASHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREEKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGYVAAENHQHATMLDVDLHPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEVQLIRQMESEGIFLPSELETPNLAERALDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPASRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 3599 - protein, 3292 aa, Artificial Sequence
  derived and/or modified protein sequence (wt) from DENV-1__KC692504__SS-prME
SVTMLLMLLPTALAFHLTTRGGEPHMIVSKQERGKSLLFKTSAGVNMCTLIAMDLGELCEDTMTYKCPRITEAEPDDVDCWCNATDTWVTYGTCSQTGEHRREKRSVALAPHVGLGLETRTETWMSSEGAWRQIQRVETWALRHPGFTVIAFFLAHAIGTSITQKGIIFILLMLVTPSMAMRCVGIGNRDFVEGLSGATWVDVVLEHGSCVTTMAKNKPTLDIELLKTEVMNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKRGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNTTFIIDGPDTPECPDGQRAWNIWEVEDYGFGVFTTNIWLKLRDSYTQMCDHRLMSAAIKDSKAVHADMGYWIESEKNETWKLARASFIEVKTCTWPKSHTLWSNGVLESEMIIPKIFGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCVSIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMMLKLLTEFQPHQLWTTLLSLTFVKTTLSLDYAWKTTAMVLSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEQEAEHSGASHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGYVAAENHQHATMLDVDLHPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANVFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEVQLIRQMESEGIFLPSELETPNLAERALDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPASRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 3600 - protein, 3292 aa, Artificial Sequence
  derived and/or modified protein sequence (wt) from DENV-1__KC692508__SS-prME
SVTMLLMLLPTALAFHLTTRGGEPHMIVSKQERGKSLLFKTSAGVNMCTLIAMDLGELCEDTMTYKCPRITEAEPDDVDCWCNATDTWVTYGTCSQTGEHRREKRSVALAPHVGLGLETRTETWMSSEGAWKQIQRVETWALRHPGFTVIAFFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKRGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNTTFIIDGPDTPECPDGQRAWNIWEVEDYGFGVFTTNIWLKLRDSYTQMCDHRLMSAAIKDSKAVHADMGYWIESEKNETWKLARASFIEVKTCTWPKSHTLWSNGVLESEMIIPKIFGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCVSIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMMLKLLTEFQPHQLWTTLLSLTFVKTTLSLDYAWKTTAMVLSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEQEAEHSGASHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEEHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGYVAAENHQHATMLDVDLHPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWSFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEVQLIRQMESEGIFLPSELETPNLAERALDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPASRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 3601 - protein, 3292 aa, Artificial Sequence
  derived and/or modified protein sequence (wt) from DENV-1__KC692509__SS-prME
SVTMLLMLLPTALAFHLTTRGGEPHMIVSKQERGKSLLFKTSAGVNMCTLIAMDLGELCEDTMTYKCPRITEAEPDDVDCWCNATDTWVTYGTCSQTGEHRREKRSVALAPHVGLGLETRTETWMSSEGAWKQIQRVETWALRHPGFTVIAFFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGVSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKRGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNTTFIIDGPDTPECPDGQRAWNIWEVEDYGFGVFTTNIWLKLRDSYTQMCDHRLMSAAIKDSKAVHADMGYWIESEKNETWKLARASFIEVKTCTWPKSHTLWSNGVLESEMIIPKIFGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCVSIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMMLKLLTEFQPHQLWTTLLSLTFVRTTLSLDYAWKTTAMVLSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEQEAEHSGASHNILVEVQDDGTMKIKDEERDDTLTILLKATLLAVSGVYPMSIPATLFVWYFWQKKKQRSGVLWDTPSPPEMERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGYVAAENHQHATMLDVDLHPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEVQLIRQMESEGIFLPSELETPNLAERALDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPASRTTWSIHAHHQWMTTEDMLSVWNRVWIEENPWMEDKTHVSSWEEVPYLGKREDQWCGSLIGLTARATWATNIQVAISQVRRLIGNENYLDYMTSMKRFKNESDPEGALW

SEQ ID NO: 3602 - protein, 3292 aa, Artificial Sequence
  derived and/or modified protein sequence (wt) from DENV-1__KC692510__SS-prME
SVTMLLMLLPTALAFHLTTRGGEPHMIVSKQERGKSLLFKTSAGVNMCTLIAMDLGELCEDTMTYKCPRITEAEPDDVDCWCNATDTWVTYGTCSQTGEHRREKRSVALAPHVGLGLETRTETWMSSEGAWRQIQRVETWALRHPGFTVIAFFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKRGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNTTFIIDGPDTPECPDGQRAWNIWEVEDYGFGVFTTNIWLKLRDSYTQMCDHRLMSAAIKDSKAVHADMGYWIESEKNETWKLARASFIEVKTCTWPKSHTLWSNGVLESEMIIPKIFGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCVSIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMMLKLLTEFQPHQLWTTLLSLTFVKTTLSLDYAWKTTAMVLSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEQEAEHSGASHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGYVAAENHQHATMLDVDLHPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEVQLIRQMESEGIFLPSELETPNLAERALDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPASRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 3603 - protein, 3292 aa, Artificial Sequence
  derived and/or modified protein sequence (wt) from DENV-1__KC692511__SS-prME
SVTMLLMLLPTALAFHLTTRGGEPHMIVSKQERGKSLLFKTSVGVNMCTLIAMDLGELCEDTMTYKCPRITEAEPDDVDCWCNATDTWVTYGTCSQTGEHRRDKRSVALAPHVGLGLETRTETWMSSEGAWKQIQKVENWALRHPGFTVIALFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQVKYEGTDAPCKIPFLTQDEKGVTQNGRLITANPIVTDKEKPVNIETEPPFGESYIVVGAGEKALKLSWFKKGSSIGKMFEATARGARRMAILGDTAWDFGSIGGLFTSVGKLIHQIFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNYILLENDMKFTVVVGDINGILAQGKKMIRPQPMEHKYSWKSWGKAKIIGADIQNTTFIIDGPDTPECPNDQRAWNIWEVEDYGFGIFTTNIWLKLRDSHTQMCDHRLMSAAIKDSKAVHADMGYWIESEKNETWKLARASFIEVKTCIWPKSHTLWSNGVLESEMVIPKIYGGPISQHNYRPGYFTQTAGPWHLGKLELDFDLCEGTTVVVDEHCGYRGPSLRTTTVTGKIIHEWCCRSCTLPPLRFRGEDGCWYGMEIRPVKEKEENLVRSMVSAGSGEVDSFSLGILCVSILIEEVMRSRWSRKMLMTGTLAVFLLLIMGQLTWNDLIRLCIMVGANASDRMGMGTTYLALMATFKMRPMFAVGLLFRRLTSREVLLLTVGLSLVASVELPNSLEELGDGLAMGIMMLKLLTDFQPHQLWTTLLSLTFIRTSLSLDYAWKTMAMALSIVSLFPLCLSTTSQKTTWLPVLLGSFGCKPLTMFLITENKIWGRKSWPINEGIMAVGIVSILLSSLLKNDVPLAGPLIAGGMLIACYVISGSSADLSLEKAAEVSWEEEAEHSGTSHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKATQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKEGPERVILAGPMPVTVASAAQRRGRIGRNQNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVMASSALLWMASVEPHWIAASIILEFFLMVLLIPEPDRQRTPQDNQLAYVVIGLLFMILTVAANEMGLLETTKKDLGIGHVAVENHHHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVTIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKKSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKSGTVMDVISRRDQRGSGQVGTYGLNTFTNMEVQLIRQMESEGIFSPSELETPNLAKKVLDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 3604 - protein, 3292 aa, Artificial Sequence
  derived and/or modified protein sequence (wt) from DENV-1__KC692512__SS-prME
SVTMLLMLLPTALAFHLTTRGGEPHMIVSKQERGKSLLFKTSAGVNMCTLIAMDLGELCEDTMTYKCPRITEAEPDDVDCWCNATDTWVTYGTCSQTGEHRREKRSVALAPHVGLGLETRTETWMSSEGAWKQIQRVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKRGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNTTFIIDGPDTPECPDGQRAWNIWEVEDYGFGVFTTNIWLKLRDSYTQMCDHRLMSAAIKDSKAVHADMGYWIESEKNETWKLARASFIEVKTCTWPKSHTLWSNGVLESEMIIPKIFGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCVSIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMMLKLLTEFQPHQLWTTLLSLTFVKTTLSLDYAWKTTAMVLSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEQEAEHSGASHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREEKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGHVAAENHQHSTMLDVDLHPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHRSTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEVQLIRQMESEGIFLPSELETPNLAERALDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPASRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 3605 - protein, 3292 aa, Artificial Sequence
  derived and/or modified protein sequence (wt) from DENV-1__KC692513__SS-prME
SVTMLLMLLPTALAFHLTTRGGEPHMIVSKQERGKSLLFKTSVGVNMCTLIAMDLGELCEDTMTYKCPRITEAEPDDVDCWCNATDTWVTYGTCSQTGEHRRDKRSVALAPHVGLGLETRTETWMSSEGAWKQIQKVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTPQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQVKYEGTDAPCKIPFLTQDEKGVTQNGRLITANPIVTDKEKPVNIETEPPFGESYIVVGAGEKALKLSWFKKGSSIGKMFEATARGARRMAILGDTAWDFGSIGGLFTSVGKLIHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNYILLENDMKFTVVVGDINGILAQGKKMIRPQPMEHKYSWKSWGKAKIIGADIQNTTFIIDGPDTPECPDDQRAWNIWEVEDYGFGIFTTNIWLKLRDSHTQMCDHRLMSAAIKDSKAVHADMGYWIESEKNETWKLARASFIEVKTCIWPKSHTLWSNGVLESEMVIPKIYGGPISQHNYRPGYFTQTAGPWHLGKLELDFDLCEGTTVVVDEHCGYRGPSLRTTTVTGKIIHEWCCRSCTLPPLRFRGEDGCWYGMEIRPVKEKEENLVRSMVSAGSGEVDSFSLGILCVSILIEEVMRSRWSRKMLMTGTLAVFLLLIMGQLTWNDLIRLCIMVGANASDRMGMGTTYLALMATFKMRPMFAVGLLFRRLTSREVLLLTVGLSLVASVELPNSLEELGDGLAMGIMMLKLLTDFQPHQLWTTLLSLTFIRTSLSLDYAWKTMAMALSIVSLFPLCLSTTSQKTTWLPVLLGSFGCKPLTMFLITENKIWGRKSWPINEGIMAVGIVSILLSSLLKNDVPLAGPLIAGGMLIACYVISGSSADLSLEKAAEVSWEEEAEHSGTSHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKATQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKEGPERVILAGPMPVTVASAAQRRGRIGRNQNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVMASSALLWMASVEPHWIAASIILEFFLMVLLIPEPDRQRTPQDNQLAYVVIGLLFMILTVAANEMGLLETTKKDLGIGHVAVENHHHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVTIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKKSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKSGTVMDVISRRDQRGSGQVGTYGLNTFTNMEVQLIRQMESEGIFSPSELETPNLAKKVLDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGSENYLDYMTSMKRFKNESDPEGALW

SEQ ID NO: 3606 - protein, 3292 aa, Artificial Sequence
  derived and/or modified protein sequence (wt) from DENV-1__KC692514__SS-prME
SVTMLLMLLPTALAFHLTTRGGEPHMIVSKQERGKSLLFKTSAGVNMCTLIAMDLGELCEDTMTYKCPRITEAEPDDVDCWCNATDTWVTYGTCSQTGEHRREKRSVALAPHVGLGLETRTETWMSSEGAWRQIQRVETWALRHPGFTVIAFFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKRGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNTTFIIDGPDTPECPDGQRAWNIWEVEDYGFGVFTTNIWLKLRDSYTQMCDHRLMSAAIKDSKAVHADMGYWIESEKNETWKLARASFIEVKTCTWPKSHTLWSNGVLESEMIIPKIFGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCVSIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMMLKLLTEFQPHQLWTTLLSLTFVKTTLSLDYAWKTTAMVLSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEQEAEHSGASHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKTSQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGYVAAENHQHATMLDVDLHPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEVQLIRQMESEGIFLPSELETPNLAERALDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPASRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 3607 - protein, 3292 aa, Artificial Sequence
  derived and/or modified protein sequence (wt) from DENV-1__KC692515__SS-prME
SVTMLLMLLPTALAFHLTTRGGEPHMIVSKQERGKSLLFKTSAGVNMCTLIAMDLGELCEDTMTYKCPRITEAEPDDVDCWCNATDTWVTYGTCSQTGEHRREKRSVALAPHVGLGLETRTETWMSSEGAWKQIQRVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQVKYEGTDAPCKIPFSTQDEKGVTQNGRLITANPIVTDKEKPVNIETEPPFGESYIVVGAGGKALKLSWFKRGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNTTFIIDGPDTPECPDGQRAWNIWEVEDYGFGVFTTNIWLKLRDSYTQMCDHRLMSAAIKDSKAVHADMGYWIESEKNETWKLARASFIEVKTCTWPKSHTLWSNGVLESEMIIPKIFGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCVSIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMMLKLLTEFQPHQLWTTLLSLTFVKTTLSLDYAWKTTAMVLSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEQEAEHSGASHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREEKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGHVAAENHQHSTMLDVDLHPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHRSTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEVQLIRQMESEGIFLPSELETPNLAERALDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPASRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 3608 - protein, 3292 aa, Artificial Sequence
  derived and/or modified protein sequence (wt) from DENV-1__KC692516__SS-prME
SVTMLLMLLPTALAFHLTTRGGEPHMIVSKQERGKSLLFKTSAGVNMCTLIAMDLGELCEDTMTYKCPRITEAEPDDVDCWCNATDTWVTYGTCSQTGEHRREKRSVALAPHVGLGLETRTETWMSSEGAWKQIQRVETWALRHPGFTVIAFFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKRGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNTTFIIDGPDTPECPDGQRAWNIWEVEDYGFGIFTTNIWLKLRDSYTQMCDHRLMSAAIKDSKAVHADMGYWIESEKNETWKLARASFIEVKTCTWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDNFSLGILCVSIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASLELPNSLEELGDGLAMGIMMLKLLTEFQPHQLWTTLLSLTFVKTTLSLDYAWKTTAMVLSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEQEAEHSGASHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWACVKKDLISYGGGWRFQGLWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGHVAAENHQHATMLDVDLHPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLRGNQFCIKILNPYMPSVVETLEQMQRKHGGMLVRNPLSRNSTHEMYWVSRGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAIGAVFVDEKQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEVQLIRQMESEGIFLPSELETPNLAERVLDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 3609 - protein, 3292 aa, Artificial Sequence
  derived and/or modified protein sequence (wt) from DENV-1__KC692517__SS-prME
SVTMLLMLLPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETIEHGTIATITPQAPTSEIQLTDYGALTLDCSPRTGLDFNEMVLLTMKEKSWLVHKQWFLDLPLPWTSGASTPQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQVKYEGTDAPCKIPFSTQDEKGVTQNGRLITANPIVTDKEKSVNIETEPPFGESYIVVGVGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNTTFIIDGPDTPECPDGQRAWNIWEVEDYGFGIFTTNIWLKLRDSYTQMCDHRLMSAAIKDSKAVHADMGYWIESEKNETWKLARASFIEVKTCTWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCVSIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMMLKLLTEFQPHQLWTTLLSLTFVKTTLSLDYAWKTTAMVLSIVSLFPLCLSTTSQKTTWLPVLLGSFGCNPLTMFLITENKIWGRKSWPLNEGIMAIGIVSILLSSLLKNDVPLAGPLIAGGMLIACYVISGSSADLSLEKAAEVSWEQEAEHSGASHNILVEVQDDGTMKIKDEERDDTLTILLKATLLAVSGVYPMSIPATLFVWYFWQKKKQRSGVLWDTPSPPKVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGYVAAENHQHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEVQLVRQMESEGIFLPSELETPNLAERVLDWLEKHGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 3610 - protein, 3292 aa, Artificial Sequence
  derived and/or modified protein sequence (wt) from DENV-1__KC762649__SS-prME
SVTMLLMLMPTALAFHLTTRGGEPHMIVSKQERGKSLLFKTSAGVNMCTLIAMDLGELCEDTLTYKCPRITEAEPDDVDCWCNATDTWVTYGTCSQTGEHRRDKRSVALAPHVGLGLETRTETWMSSEGAWKQIQRVETWALRHPGFTVIALFLAHAIGASITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVSKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEHKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGIFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRVGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTTQIMEVTARWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKAIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWEDVPYLGKREDQWCGSLIGLTARATWATNIQVAINQVRRLIGNENYLDYMTSMKRFKNESDPEGALW

SEQ ID NO: 3611 - protein, 3292 aa, Artificial Sequence
  derived and/or modified protein sequence (wt) from DENV-1__KC762625__SS-prME
SVTMLLMLMPTALAFHLTTRGGEPHMIVSKQERGKSLLFKTSAGVNMCTLIAMDLGELCEDTLTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVSKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEHKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKSCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRVGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTTQIMEVTARWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKAIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWEDVPYLGKREDQWCGSLIGLTARATWATNIQVAINQVRRLIGNENYLDYMTSMKRFKNESDPEGALW

SEQ ID NO: 3612 - protein, 3292 aa, Artificial Sequence
  derived and/or modified protein sequence (wt) from DENV-1__KC762635__SS-prME
SVTMLLMLMPTALAFHLTTRGGEPHMIVSKQERGKSLLFKTSAGVNMCTLIAMDLGELCEDTLTYKCPRITEAEPDDVDCWCNATDTWVTYGTCSQTGEHRRDKRSVALAPHVGLGLETRTETWMSSEGAWRQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEHKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFNLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRVGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTTQIMEVTARWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKAIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWEDVPYLGKREDQWCGSLIGLTARATWATNIQVAINQVRRLIGNENYLDYMTSMKRFKNESDPEGALW

SEQ ID NO: 3613 - protein, 3292 aa, Artificial Sequence
  derived and/or modified protein sequence (wt) from DENV-1__KC762650__SS-prME
SVTMLLMLMPTALAFHLTTRGGEPHMIVSKQERGKSLLFKTSAGVNMCTLIAMDLGELCEDTLTYKCPRITEAEPDDVDCWCNATDTWVTYGTCSQTGEHRRDKRSVALAPHVGLGLETRTETWMSSEGAWRQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEHKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFNLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRVGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAIEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTTQIMEVTARWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKAIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWEDVPYLGKREDQWCGSLIGLTARATWATNIQVAINQVRRLIGNENYLDYMTSMKRFKNESDPEGALW

SEQ ID NO: 3614 - protein, 3292 aa, Artificial Sequence
  derived and/or modified protein sequence (wt) from DENV-1__KC762623__SS-prME
SVTMLLMLMPTALAFHLTTRGGEPHMIVSKQERGKSLLFKTSAGVNMCTLIAMDLGELCEDTLTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVSKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEHKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKSCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFLWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRVGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTTQIMEVTARWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKAIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWEDVPYLGKREDQWCGSLIGLTARATWATNIQVAINQVRRLIGNENYLDYMTSMKRFKNESDPEGALW

SEQ ID NO: 3615 - protein, 3292 aa, Artificial Sequence
  derived and/or modified protein sequence (wt) from DENV-1__KC762632__SS-prME
SVTMLLMLMPTALAFHLTTRGGEPHMIVSKQERGKSLLFKTSAGVNMCTLIAMDLGELCEDTLTYKCPRITEAEPDDVDCWCNATDTWVTYGTCSQTGEHRRDKRSVALAPHVGLGLETRTETWMSSEGAWRQMQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNITTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEHKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFNLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRVGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLDQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTTQIMEVTARWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKAIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWEDVPYLGKREDQWCGSLIGLTARATWATNIQVAINQVRRLIGNENYLDYMTSMKRFKNESDPEGALW

SEQ ID NO: 3616 - protein, 3292 aa, Artificial Sequence
  derived and/or modified protein sequence (wt) from DENV-1__KC762637__SS-prME
SVTMLLMLMPTALAFHLTTRGGEPHMIVSKQERGKSLLFKTSAGVNMCTLIAMDLGELCEDTLTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEHKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRVGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTTQIMEVTARWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKAIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWEDVPYLGKREDQWCGSLIGLTARATWATNIQVAINQVRRLIGNENYLDYMTSMKRFKNESDPEGALW

SEQ ID NO: 3617 - protein, 3292 aa, Artificial Sequence
  derived and/or modified protein sequence (wt) from DENV-1__KC762620__SS-prME
SVTMLFMLLPTALAFHLTTRGGEPHMIVSKQERGKSLLFKTSAGVNMCTLIAMDLGELCEDTMTYKCPRITETEPDDVDCWCNATETWVTYGTCSQTGEHRRDKRSVALAPHVGLGLETRTETWMSSEGAWKQIQKVETWALRHPGFTVIALFLAHAIGTSITQKGIIFILLMLVTPSMAMRCVGIGNRDFVEGLSGATWVDVVLEHGSCVTTMAKDKPTLDIELLKTEVTNPAVLRKLCIEAKISNTTTDSRCPTQGEATLVEEQDTNFVCRRTFVDRGWGNGCGLFGKGSLITCAKFKCVTKLEGKIVQYENLKYSVIVTVHTGDQHQVGNETIEHGTTATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGVSYVMCTGSFKLEKEVAETQHGTVLVQVKYEGTDAPCKIPFSSQDERGVIQNGRLITANPIVTDKEKPVNIEAEPPFGESYIVVGAGEKALKLSWFKKGSSIGKMFEATARGARRMAILGDTAWDFGSIGGVFTSVGKLVHQIFGTAYGVLFSGVSWTMKIGIGILLTWLGLNSRNTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVSGILAQGKKMIRPQPMEHKYSWKSWGKAKIIGADVQNTTFIIDGPNTPECPDNQRAWNIWEVEDYGFGVFTTNIWLKLRDSYTQVCDHRLMSAAIKDSKAVHADMGYWIESEKNETWKLERASFIEVKTCIWPRSHTLWSNGVLESEMIIPKTYGGPVSQHNYRPGYFTQTAGPWHLGKLELDFDLCEGTTVVVDENCGNRGPSLRTTTVTGKIIHEWCCRSCTLPPLRFKGEDGCWYGMEIRPVKEKEENLVKSMVSAGSGEVDSFSLGLLCISIMIEEVMRSRWSGKMLMTGTLAVFLLLTMGQLTWNDLIRLCIMVGANASDMMGMGTTYLALMATFRMRPMFAVGLLFRRLTSREVLLLTVGLSLAASVELPNSLEELGDGLAMGIMMLKLLTDFQSHQLWATLLSLTFVKTTFSLHYAWKTMAMILSIVSLFPLCLSTTSQKTTWLPVLLGSLGCKPLTMLLITENKIWGRRSWPINEGIMAIGIVSILLSSLLKNDVPLAGPLIAGGMLIACYVISGSSADLSLEKAAEVSWEDEAEHSGASHNILVEVQDDGTMKIKDEERDDTLTILLKATLLAISGVYPMSIPATLFVWYFWQKKKQRSGVLWDTPSPPEVERAVLDDGIYRILQRGLLGRSQVGVGVFQEGVFHTMWHVTRGAVLMYQGKRLEPSWASVKKDLISYGGGWRFQGSWNTGEEVQVIAVEPGKNPKNVQTTPGTFKTSEGEVGAIALDFKPGTSGSPIVNREGKIVGLYGNGVVTTSGTYVSAIAQAKASQEGPLPEIEDEVFRKRNLTIMDLHPGSGKTRRYLPAILREAIKRKLRTLVLAPTRVVASEMAEALKGMPIRYQTTAVKSEHTGKEIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVVQLSRKTFDTEYQKTKNNDWDYVVTTDISEMGANFRADRVIDPRRCLKPVILKDGPERVILAGPMPVTVASAAQRRGRIGRNSNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQKAQNALDNLVMLHNSEQGGKAYRHAMEELPDTIETLMLLALIAVLTGGVTLFFLSGRGLGKTSIGLLCVMASSALLWMASVEPHWIAASIILEFFLMVLLIPEPDRQRTPQDNQLAYVVIGLLFMILTVAANEMGLLETTKKDLGIGHAAAENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNIYKRSGIMEVDRSEAKEGLKRGETTKHAVSRGTAKLRWFVERNLVKPEGKVIDLGCGRGGWSYYCAGLKKVTEVKGYTKGGPGHEEPVPMATYGWNLVKLHSGKDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYEKDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNLYADDTAGWDTRITEDDLQNEAKITDIMEPEHALLATSIFKLTYQNKVVRVQRPAKNGTVMDVISRRDQRGSGQVGTYGLNTFTNMEAQLIRQMESEGIFSPSELETPNLAKRVLDWLEKHGIERLKRMAISGDDCVVKPIDDRFATALTALNDMGKVRKDIPQWEPSKGWNDWQQVPFCSHHFHQLIMKDGREIVVPCRNQDELIGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEDVPYLGKREDQWCGSLIGLTARATWASNIQVAINQVRRLIGNENYLDYMTSMKRFKNESDPEGALW

SEQ ID NO: 3618 - protein, 3292 aa, Artificial Sequence
  derived and/or modified protein sequence (wt) from DENV-1__KC762631__SS-prME
SVTMLLMLMPTALAFHLTTRGGEPHMTVSKQERGKSLLFKTSAGVNMCTLIAMDLGELCEDTLTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEHKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENLFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNLGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRVGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPETIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTTQIMEVTARWLWGFLSRNKKPRICTREEFTRKVRSNAAIGAVFVDENQWNSAKEAVEDERFWELVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKAIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWEDVPYLGKREDQWCGSLIGLTARATWATNIQVAINQVRRLIGNENYLDYMTSMKRFKNESDPEGALW

SEQ ID NO: 3619 - protein, 3292 aa, Artificial Sequence
  derived and/or modified protein sequence (wt) from DENV-1__KC762621__SS-prME
SVTMLLMLMPTALAFHLTTRGGEPHMIVSKQERGKSLLFKTSAGVNMCTLIAMDLGELCEDTLTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEHKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPTSQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRVGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGYVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTTQIMEVTARWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKAIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEDVPYLGKREDQWCGSLIGLTARATWATNIQVAINQVRRLIGNENYLDYMTSMKRFKNESDPEGALW

SEQ ID NO: 3620 - protein, 3292 aa, Artificial Sequence
  derived and/or modified protein sequence (wt) from DENV-1__KC762643__SS-prME
SVTMLLMLMPTALAFHLTTRGGEPHMIVSKQERGKSLLFKTSAGVNMCTLIAMDLGELCEDTLTYKCPRITEAEPDDVDCWCNATDTWVTYGTCSQTGEHRRDKRSVALAPHVGLGLETRTETWMSSEGAWKQIQRVETWALRHPGFTVMALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVLTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEHKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPTSQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRVGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTTQIMEVTARWLWGFLSRNKKPRICTREEFIRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKAIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKAHVSSWEDVPYLGKREDQWCGSLIGLTARATWATNIQVAINQVRRLIGNENYLDYMTSMKRFKNESDPEGALW

SEQ ID NO: 3621 - protein, 3292 aa, Artificial Sequence
  derived and/or modified protein sequence (wt) from DENV-1__KC762651__SS-prME
SVTMLFMLLPTALAFHLTTRGGEPHMIVSKQERGKSLLFKTSAGVNMCTLIAMDLGELCEDTMTYKCPRITETEPDDVDCWCNATETWVTYGTCSQTGEHRRDKRSVALAPHVGLGLETRTETWMSSEGAWKQIQKVETWALRHPGFTVIALFLAHAIGTSITQKGIIFILLMLVTPSMAMRCVGIGNRDFVEGLSGATWVDVVLEHGSCVTTMAKDKPTLDIELLKTEVTNPAVLRKLCIEAKISNTTTDSRCPTQGEATLVEEQDTNFVCRRTFVDRGWGNGCGLFGKGSLITCAKFKCVTKLEGKIVQYENLKYSVIVTVHTGDQHQVGNETTEHGTTATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGVSYVMCTGSFKLEKEVAETQHGTVLVQVKYEGTDAPCKIPFSSQDERGVIQNGRLITANPIVTDKEKPVNIEAEPPFGESYIVVGAGEKALKLSWFKKGSSIGKMFEATARGARRMAILGDTAWDFGSIGGVFTSVGKLVHQIFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVSGILAQGKKMIRPQPMEHKYSWKSWGKAKIIGADVQNTTFIIDGPNTPECPDNQRAWNIWEVEDYGFGVFTTNIWLKLRDSYTQVCDHRLMSAAIKDSKAVHADMGYWIESEKNETWKLERASFIEVKTCIWPRSHTLWSNGVLESEMIIPKTYGGPVSQHNYRPGYFTQTAGPWHLGKLELDFNLCEGTTVVVDENCGNRGPSLRTTTVTGKIIHEWCCRSCTLPPLRFKGEDGCWYGMEIRPVKEKEENLVKSMVSAGSGEVDSFSLGLLCISIMIEEVMRSRWSGKMLMTGTLAVFLLLTMGQLTWNDLIRLCIMVGANASDMMGMGTTYLALMATFRMRPMFAVGLLFRRLTSREVLLLTVGLSLVASVELPNSLEELGDGLAMGIMMLKLLTDFQSHQLWATLLSLTFVKTAFSLHYAWKTMAMILSIVSLFPLCLSTTSQKTTWLPVLLGSLGCKPLTMLLITENKIWGRRSWPLNEGIMAIGIVSILLSSLLKNDVPLAGPLIAGGMLIACYVISGSSADLSLEKAAEVSWEDEAEHSGASHNILVEVQDDGTMKIKDEERDDTLTILLKATLLAISGVYPMSIPATLFVWYFWQKKKQRSGVLWDTPSPPEVERAVLDDGIYRILQRGLLGRSQVGVGVFQEGVFHTMWHVTRGAVLMYQGKRLEPSWASVKKDLISYGGGWRFQGSWNTGEEVQVIAVEPGKNPKNVQTTPGTFKTSEGEVGAIALDFKPGTSGSPIVNREGKIVGLYGNGVVTTSGTYVSAIAQAKASQEGPLPEIEDEVFRKRNLTIMDLHPGSGKTRRYLPAILREAIKRKLRTLVLAPTRVVASEMAEALKGMPIRYQTTAVKSEHTGKEIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVVQLSRKTFDTEYQKTKNNDWDYVVTTDISEMGANFRADRVIDPRRCLKPVILKDGPERVILAGPMPVTVASAAQRRGRIGRNPNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQKAQNALDNLVMLHNSEQGGKAYRHAMEELPDTIETLMLLALIAVLTGGVTLFFLSGRGLGKTSIGLLCVMASSALLWMASVEPHWIAASIILEFFLMVLLIPEPDRQRTPQDNQLAYVVIGLLFMILTVAANEMGLLETTKKDLGIGHAAAENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNIYKRSGIMEVDRSEAKEGLKRGETTKHAVSRGTAKLRWFVERNLVKPEGKVIDLGCGRGGWSYYCAGLKKVTEVKGYTKGGPGHEEPVPMATYGWNLVKLHSGKDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNLYADDTAGWDTRITEDDLQNEAKITDIMEPEHALLATSIFKLTYQNKVVRVQRPAKNGTVMDVISRRDQRGSGQVGTYGLNTFTNMEAQLIRQMESEGIFSPSELETPNLAKRVLDWLEKHGIERLKRMAISGDDCVVKPIDDRFATALTALNDMGKVRKDIPQWEPSKGWNDWQQVPFCSHHFHQLIMKDGREIVVPCRNQDELIGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEDVPYLGKREDQWCGSLIGLTARATWASNIQVAINQVRRLIGNENYLDYMTSMKRFKNESDPEGALW

SEQ ID NO: 3622 - protein, 3292 aa, Artificial Sequence
  derived and/or modified protein sequence (wt) from DENV-1__KC762653__SS-prME
SVTMLLMLLPTALAFHLTTRGGEPHMIVSKQERGKSLLFKTSAGVNMCTLIAMDLGELCEDTMTYKCPRITETEPDDVDCWCNATETWVTYGTCYQTGEHRRDKRSVALAPHVGLGLETRTETWMSSEGAWRQIQKVETWALRHPGFTVIALFLAHAIGTSITQKGIIFILLMLVTPSMAMRCVGIGNRDFVEGLSGATWVDVVLEHGSCVTTMAKDKPTLDIELLKTEVTNPAVLRKLCIEAKISNTTTDSRCPTQGEATLVEEQDTNFVCRRTFVDRGWGNGCGLFGKGSLITCAKFKCVTKLEGKIVQYENLKYSVIVTVHTGDQHQVGNETTEHGTTATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQVKYEGTDAPCKIPFSSQDEKGVTQNGRLITANPIVTDKEKPVNIEAEPPFGESYLVVGAGEKALKLSWFKKGSSIGKMFEATARGARRMAILGDTAWDFGSIGGVFTSVGKLIHQIFGTAYGVLFSGVSWTMKIGIGILLTWLGLNSRSTSLSMTCIAVGMITLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGEVNGILAQGKKMIRPQPMEHKYSWKSWGKAKVIGADVQNTTFIIDGPNTPECPDNQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFELCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFLLLTMGQLTWNDLIRLCIMVGANASDKMGMGTTYLALMATFRMRPMLAVGLLFRRLTSREVLLLTVGLSLVASVELPNSLEELGDGLAMGIMMLKLLTDFQSHQLWAALLSLTFVKTTLSLHYAWKTMAMILSIVSLFPLCLSTTSQKTTWLPVLLGSLGCKPLTMFLITENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAISGVYPMSIPATLFVWYFWQKKKQRSGVLWDTPSPPEVEKAVLDDGIYRILQRGLLGKSQVGVGVFQEGVFHTMWHVTRGAVLMYQGKRLEPSWASVKKDLISYGGGWRFQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLVLAPTRVVASEMAEALKGMPIRYQTTAVKSEHTGKEIVDLMCHATFTMRLLSPVRVPNYNMIIMDEAHFTDPASIAARGYISTRVGMGEAAAIFMTATPPGSMEAFPQSNAAIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGKAYRHAMEELPDTIETLMLLALIAVLTGGVTLFFLSGRGLGKTSIGLLCVMASSALLWMASVEPHWIAASIILEFFLMVLLIPEPDRQRTPQDNQLAYVVIGLLFMILTVAANEMGLLETTKKDLGIGHAAAENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFTPPEKCDTLLCDIGESSPNPTIEEGRTLRVLKMVEPWLRGNQFCIKVLNPYMPSVIETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEAQLIRQMESEGIFTPSELETPNLAERVLDWLEKHGIERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEDVPYLGKREDQWCGSLIGLTARATWATNIQVAINQVRRLIGNENYLDYMTSMKRFKNESDPEGALW

SEQ ID NO: 3623 - protein, 3292 aa, Artificial Sequence
  derived and/or modified protein sequence (wt) from DENV-1__KC762640__SS-prME
SVTMLLMLLPTALAFHLTTRGGEPHMIVSKQERGKSLLFKTSAGVNMCTLIAMDLGELCEDTMTYKCPRITETEPDDVDCWCNATETWVTYGTCSQTGEHRRDKRSVALAPHVGLGLETRTETWMSSEGAWRQIQKVETWALRHPGFTVIALFLAHAIGTSITQKGIIFILLMLVTPSMAMRCVGIGNRDFVEGLSGATWVDVVLEHGSCVTTMAKDKPTLDIELLKTEVTNPAVLRKLCIEAKISNTTTDSRCPTQGEATLVEEQDTNFVCRRTFVDRGWGNGCGLFGKGSLITCAKFKCVTKLEGKIVQYENLKYSVIVTVHTGDQHQVGNETTEHGTTATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGVSYVMCTGSFKLEKEVAETQHGTVLVQVKYEGTDAPCKIPFSSQDEKGVTQNGRLITANPIVTDKEKPVNIEAEPPFGESYLVVGAGEKALKLSWFKKGSSIGKMFEATARGARRMAILGDTAWDFGSIGGVFTSVGKLIHQIFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGEVNGILAQGKKMIRPQPMEHKYSWKSWGKAKVIGADVQNTTFIIDGPNTPECPDNQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFELCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFLLLTMGQLTWNDLIRLCIMVGANASDKMGMGTTYLALMATFRMRPMFAVGLLFRRLTSREVLLLTVGLSLVASVELPNSLEELGDGLAMGIMMLKLLTDFQSHQLWAALLSLTFVKTTLSLHYAWKTMAMILSIVSLFPLCLSTTSQKTTWLPVLLGSLGCKPLTMFLITENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAISGVYPMSIPATLFVWYFWQKKKQRSGVLWDTPSPPEVEKAVLDDGIYRILQRGLLGKSQVGVGVFQEGVFHTMWHVTRGAVLMYQGKRLEPSWASVKKDLISYGGGWRFQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLVLAPTRVVASEMAEALKGMPIRYQTTAVKSEHTGKEIVDLMCHATFTMRLLSPVRVPNYNMIIMDEAHFTDPASIAARGYISTRVGMGEAAAIFMTATPPGSMEAFPQSNAAIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGKAYRHAMEELPDTIETLMLLALIAVLTGGVTLFFLSGRGLGKTSIGLLCVMASSALLWMASVEPHWIAASIILEFFLMVLLIPEPDRQRTPQDNQLAYVVIGLLFMILTVAANEMGLLETTKKDLGIGHAAAENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLYSGKDVFFTPPEKCDTLLCDIGESSPNPTIEEGRTLRVLRMVEPWLRGNQFCIKVLNPYMPSVIETLEQMQRKHGGMLVRNPLSRNSTHEMYWVSCGTGNIVSAVNMTSRMLLNRFTMAHRKPTYERDVDLGAGTRHVAVEPEVANLEIIGQRIENIKNEHKSTWHYDEDNPYKTWAYHGSYEVKPSGSASSMVNGVVRLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEAQLIRQMESEGIFTPSELETPNLAERVLDWLEKHGIERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEDVPYLGKREDQWCGSLIGLTARATWATNIQVAINQVRRLIGNENYLDYMTSMKRFKNESDPEGALW

SEQ ID NO: 3624 - protein, 3292 aa, Artificial Sequence
  derived and/or modified protein sequence (wt) from DENV-1__KC762645__SS-prME
SVTMLLMLMPTALAFHLTTRGGEPHMIVSKQERGKSLLFKTSAGVNMCTLIAMDLGELCEDTLTYKCPRITEAEPDDVDCWCNATDTWVTYGTCSQTGEHRRDKRSVALAPHVGLGLETRTETWMSSEGAWRQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEHKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFNLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRVGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVQPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTTQIMEVTARWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKAIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWEDVPYLGKREDQWCGSLIGLTARATWATNIQVAINQVRRLIGNENYLDYMTSMKRFKNESDPEGALW

SEQ ID NO: 3625 - protein, 3292 aa, Artificial Sequence
  derived and/or modified protein sequence (wt) from DENV-1__KC762628__SS-prME
SVTMLLMLLPTALAFHLTTRGGEPHMIVSKQERGKSLLFKTSAGVNMCTLIAMDLGELCEDTMTYKCPRITETEPDDVDCWCNATETWVTYGTCSQTGEHRRDKRSVALAPHVGLGLETRTETWMSSEGAWRQIQKVETWALRHPGFTVIALFLAHAIGTSITQKGIIFILLMLVTPSMAMRCVGIGNRDFVEGLSGATWVDVVLEHGSCVTTMAKDKPTLDIELLKTEVTNPAVLRKLCIEAKISNTTTDSRCPTQGEATLVEEQDTNFVCRRTFVDRGWGNGCGLFGKGSLITCAKFKCVTKLEGKIVQYENLKYSVIVTVHTGDQHQVGNETTEHGTTATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGVSYVMCTGSFKLEKEVAETQHGTVLVQVKYEGTDAPCKIPFSSQDEKGVTQNGRLITANPIVTDKEKPVNIEAEPPFGESYLVVGAGEKALKLSWFKKGSSIGKMFEATARGARRMAILGDTAWDFGSIGGVFTSVGKLIHQIFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGEVNGILAQGKKMIRPQPMEHKYSWKSWGKAKVIGADVQNTTFIIDGPNTPECPDNQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFELCEGTTVVVDEHCGSRGPSLRTTTVTGKIIHEWCCRSCTLPPLRFKGEDGCWYGMEIRPVKEKEENLVKSMVSAGSGEVDSFSLGLLCMSIMIEEVMRSRWSRKMLMTGTLAVFLLLTMGQLTWNDLIRLCIMVGANASDKMGMGTTHLALMATFRMRPMFAVGLLFRRLTSREVLLLTVGLSLVASVELPNSLEELGDGLAMGIMMLKLLTDFQSHQLWAALLSLTFVKTTLSLHYAWKTMAMILSIVSLFPLCLSTTSQKTTWLPVLLGSLGCKPLTMFLITENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAISGVYPMSIPATLFVWYFWQKKKQRSGVLWDTPSPPEVERAVLDDGIYRILQRGLLGKSQVGVGVFQEGVFHTMWHVTRGAVLMYQGKRLEPSWASVKKDLISYGGGWRFQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLVLAPTRVVASEMAEALKGMPIRYQTTAVKSEHTGKEIVDLMCHATFTMRLLSPVRVPNYNMIIMDEAHFTDPASIAARGYISTRVGMGEAAAIFMTATPPGSIEAFPQSNAAIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGKAYRHAMEELPDTIETLMLLALIAVLTGGVTLFFLSGRGLGKTSIGLLCVMASSALLWMASVEPHWIAASIILEFFLMVLLIPEPDRQRTPQDNQLAYVVIGLLFMILTVAANEMGLLETTKKDLGIGHAAAENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFTPPEKCDTLLCDIGESSPNPTIEEGRTLRVLRMVEPWLRGNQFCIKVLNPYMPSVIETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEAQLIRQMESEGIFTPSELETPNLAERVLDWLEKHGIERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEDVPYLGKREDQWCGSLIGLTARATWATNIQVAINQVRRLIGNENYLDYMTSMKRFKNESDPEGALW

SEQ ID NO: 3626 - protein, 3292 aa, Artificial Sequence
  derived and/or modified protein sequence (wt) from DENV-1__KC762624__SS-prME
SVTMLLMLMPTALAFHLTTRGGEPHMIVSKQERGKSLLFKTSAGVNMCTLIAMDLGELCEDTLTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEHKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPTSQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRVGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTTQIMEVTARWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKAIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEDVPYLGKREDQWCGSLIGLTARATWATNIQVAINQVRRLIGNENYLDYMTSMKRFKNESDPEGALW

SEQ ID NO: 3627 - protein, 3292 aa, Artificial Sequence
  derived and/or modified protein sequence (wt) from DENV-1__KC762644__SS-prME
SVTMLLMLMPTALAFHLTTRGGEPHMIVSKQERGKSLLFKTSAGVNMCTLIAMDLGELCEDTLTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEHKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRVGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTTQIMEVTARWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKAIFELTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWEDVPYLGKREDQWCGSLIGLTARATWATNIQVAINQVRRLIGNENYLDYMTSMKRFKNESDPEGALW

SEQ ID NO: 3628 - protein, 3292 aa, Artificial Sequence
  derived and/or modified protein sequence (wt) from DENV-1__KC762630__SS-prME
SVTVLFMLLPTALAFHLTTRGGEPHMIVSKQERGKSLLFKTSAGVNMCTLIAMDLGELCEDTMTYKCPRITETEPDDVDCWCNATETWVTYGTCSQTGEHRRDKRSVALAPHVGLGLETRTETWMSSEGAWKQIQKVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAILRKLCIEAKISNTTTDSRCPTQGEATLVEEQDTNFVCRRTFVDRGWGNGCGLFGKGSLITCAKFKCVTKLEGKIVQYENLKYSVIVTVHTGDQHQVGNETTEHGTTAIITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGVSYVMCTGSFKLEKEVAETQHGTVLVQVKYEGTDAPCKIPFSSQDEKGVIQNGRLITANPIVTDKEKPVNIEAEPPFGESYIVVGAGEKALKLSWFKKGSSIGKMFEATARGARRMAILGDTAWDFGSIGGVFTSVGKLVHQIFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVSGILAQGKKMIRPQPMEHKYSWKSWGKAKIIGADVQNTTFIIDGPNTPECPDNQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPVSQHNYRPGYFTQTAGPWHLGKLELDFDLCEGTTVVVDENCGNRGPSLRTTTVTGKTIHEWCCRSCTLPPLRFKGEDGCWYGMEIRPVKEKEENLVKSMVSAGSGEVDSFSLGLLCISIMIEEVMRSRWSRKMLMTGTLAVFLLLTMGQLTWNDLIRLCIMVGANASDMMGMGTTYLALMATFRMRPMFAVGLLFRRLTSREILLLTVGLSLVASVELPNSLEELGDGLAMGIMMLKLLTDFQPHQLWATLLSLTFVKTTLSLHYAWKTMAMILSIVSLLPLCLSTTSQKTTWLPVLLGSLGCKPLTMFLITENKIWGRRSWPLNEGIMAIGIVSILLSSLLKNDVPLAGPLIAGGMLIACYVISGSSADLSLEKAAEVSWEDEAEHSGASHNILVEVQDDGTMKIKDEERDDTLTILLKATLLVISGVYPMSVPATLFVWYFWQKKKQRSGVLWDTPSPPEVERAVLDNGIYRILQRGLLGRSQVGVGVFQEGVFHTMWHVTRGAVLMYQGKRLEPSWASVKKDLISYGGGWRFQGSWNTGEEVQVIAVEPGKNPKNVQTTPGTFKTPEGEIGAIALDFKPGTSGSPIVNREGKIVGLYGNGVVTTSGTYVSAIAQAKVSQEGPLPEIEDEVFRKRNLTIMDLHPGSGKTRRYLPAIVREAIKRKLRTLVLAPTRVVASEMAEALKGMPIRYQTTAVKSEHTGKEIVDLMCHATFTMRLLSPVRVPNYNMIIMDEAHFTDPASIAARGYISTRVGMGEAAAIFMTATPPGSVEAFPQSNAVIQDEERDIPERSWNSGYEWITDFPGKTVWFVPSIKSGNDIANCLRKNGKRVVQLSRKTFDTEYQKTKNNDWDYVVTTDISEMGANFRADRVIDPRRCLKPVILKDGPERVILAGPMPVTVASAAQRRGRIGRNPNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLKAQNALDNLVMLHNSEQGGKAYRHAMEELPDTIETLMLLALIAVLTGGVTLFFLSGRGLGKTSIGLLCVMASSALLWMASVEPHWIAASIILEFFLMVLLIPEPDRQRTPQDNQLAYVVIGLLFMILTVAANEMGLLETTKKDLGIGHAAAENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVIYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNIYKRSGIIEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPGKNGTVMDVISRRDQRGSGQVGTYGLNTFTNMEAQLIRQMESEGIFSPSELETPNLAERVFDWLEKHGIERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEDVPYLGKREDQWCGSLIGLTARATWATNIQVAINQVRRLIGNENYLDYMTSMKRFKNESDPEGALW

SEQ ID NO: 3629 - protein, 3292 aa, Artificial Sequence
  derived and/or modified protein sequence (wt) from DENV-1__KC762641__SS-prME
SVTMLLMLMPTALAFHLTTRGGEPHMIVSKQERGKSLLFKTSAGVNMCTLIAMDLGELCEDTLTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEHKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRVGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVTANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTTQIMEVTARWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKAIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWEDVPYLGKREDQWCGSLIGLTARATWATNIQVAINQVRRLIGNENYLDYMTSMKRFKNESDPEGALW

SEQ ID NO: 3630 - protein, 3292 aa, Artificial Sequence
  derived and/or modified protein sequence (wt) from DENV-1__KC762648__SS-prME
SVTMLLMLMPTALAFHLTTRGGEPHMIVSKQERGKSLLFKTSAGVNMCTLIAMDLGELCEDTLTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEHKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRVGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSALLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTTQIMEVTARWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKAIFKLTYQNKVVRVQRPAKNGTVMDVISRRDQRGSGQVGTYGLNTFTNMEAQLIRQMESEEIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWEDVPYLGKREDQWCGSLIGLTARATWATNIQVAINQVRRLIGNENYLDYMTSMKRFKNESDPEGALW

SEQ ID NO: 3631 - protein, 3292 aa, Artificial Sequence
  derived and/or modified protein sequence (wt) from DENV-1__KC762622__SS-prME
SVTMLLMLMPTALAFHLTTRGGEPHMIVSKQERGKSLLFKTSAGVNMCTLIAMDLGELCEDTLTYKCPRITEAEPDDVDCWCNATDTWVTYGTCSQTGEHRRDKRSVALAPHVGLGLETRTETWMSSEGAWKQIQRVETWALRHPGFTVMALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEHKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPTSQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRVGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTTQIMEVTARWLWGFLSRNKKPRICTREEFIRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKAIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKAHVSSWEDVPYLGKREDQWCGSLIGLTARATWATNIQVAINQVRRLIGNENYLDYMTSMKRFKNESDPEGALW

SEQ ID NO: 3632 - protein, 3292 aa, Artificial Sequence
  derived and/or modified protein sequence (wt) from DENV-1__KC762629__SS-prME
SVTMLLMLMPTALAFHLTTRGGEPHMVVSKQERGKSLLFKTSAGVNMCTLIAMDLGELCEDTLTYKCPRITEAEPDDVDCWCNATDTWVTYGTCSQTGEHRRDKRSVALAPHVGLGLETRTETWMSSEGAWRQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKTLKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEHKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFNLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRVGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTTQIMEVTARWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRGNSLSGVEGEGLHKLGYILRDISKIPGGNMYADDTAGWDTRITEDDLQNEAKITDIMEPEHALLAKAIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWEDVPYLGKREDQWCGSLIGLTARATWATNIQVAINQVRRLIGNENYLDYMTSMKRFKNESDPEGALW

SEQ ID NO: 3633 - protein, 3292 aa, Artificial Sequence
  derived and/or modified protein sequence (wt) from DENV-1__KC762627__SS-prME
SVTMLLMLMPTALAFHLTTRGGEPHMIVSKQERGKSLLFKTSAGVNMCTLIAMDLGELCEDTLTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLIHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEHKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISMMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRVGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTTQIMEVTARWLWSFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKAIFKLTYQNKVVRVQRPAKNGTVMDVISRRDQRGSGQVGTYGLNTFTNMEAQLIRQMESEGIFSPSELETSNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWEDVPYLGKREDQWCGSLIGLTARATWATNIQVAINQVRRLIGNENYLDYMTSMKRFKNESDPEGALW

SEQ ID NO: 3634 - protein, 3292 aa, Artificial Sequence
  derived and/or modified protein sequence (wt) from DENV-1__KC762647__SS-prME
SVTMLLMLTPTALAFHLTTRGGEPHMIVSKQERGKSLLFKTSAGVNMCTLIAMDLGELCEDTLTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEHKYSWKSWGKAKIIGADVQNTTFIIDGPNTPECPDDQRAWNIWEVEDYGFGIFTTNIWLKLRDSYTQVCDHRLMSAAIKDSRAVHADMGYWIESEKNETWKLARASFIEVKTCVWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRVGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQKAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKVLNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTTQIMEVTARWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKAIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLREPACLGKSYAQMWQLMYFHRRDLRLAANAICSAVPVDWVPTSRTTWSIHAHHQWMTTEDMLSVWNRVWIEENPWMEDKTHISSWEDVPYLGKREDQWCGSLIGLTARATWATNIQVAINQVRRLIGNENYLDYMTSMKRFKNESDPEGALW

SEQ ID NO: 3635 - protein, 3292 aa, Artificial Sequence
  derived and/or modified protein sequence (wt) from DENV-1__KC762639__SS-prME
SVTMLLMLTPTALAFHLTTRGGEPHMIVSKQERGKSLLFKTSAGVNMCTLIAMDLGELCEDTLTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEHKYSWKSWGKAKIIGADVQNTTFIIDGPNTPECPDDQRAWNIWEVEDYGFGIFTTNIWLKLRDSYTQVCDHRLMSAAIKDSRAVHADMGYWIESEKNETWKLARASFIEVKTCVWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRVGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQKAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKVLNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTTQIMEVTARWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKAIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWEDVPYLGKREDQWCGSLIGLTARATWATNIQVAINQVRRLIGNENYLDYMTSMKRFKNESDPEGALW

SEQ ID NO: 3636 - protein, 3292 aa, Artificial Sequence
  derived and/or modified protein sequence (wt) from DENV-1__KC762642__SS-prME
SVTMLLMLMPTALAFHLTTRGGEPHMIVSKQERGKSLLFKTSAGVNMCTLIAMDLGELCEDTLTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTTQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEHKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLITGTLAVFFLLIMGQVTWNDLTRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKYEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKAVFKLTYQNKVVRVQRPAKNGTVMDVISRRDQRGSGQVGTYGLNTFTNMEAQLIRQMESEGIFSPSELETPNLAERVLYWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWEDVPYLGKREDQWCGSLIGLTARATWATNIQVAINQVRRLIGNENYLDYMTSMKRFKNESDPEGALW

SEQ ID NO: 3637 - protein, 3292 aa, Artificial Sequence
  derived and/or modified protein sequence (wt) from DENV-1__JQ915077__SS-prME
SVTMLLMLLPTVLTFHLTTRGGEPHMIVSKQERGKSLLFKTSAGVNMCTLIAMDLGELCDDTMTYKCPRITETEPDDVDCWCNATETWVTYGTCSQTGEHRRDKRSVALAPHVGLGLETRTETWMSSEGAWRQIQKVETWALRHPGFTVIALFLAHAIGTSITQKGIIFILLMLVTPSMAMRCVGIGNRDFVEGLSGATWVDVVLEHGSCVTTMAKDKPTLDIELLKTEVTNPAVLRKLCIEAKISNTTTDSRCPTQGEATLVEEQDTNFVCRRTFVDRGWGNGCGLFGKGSLITCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGISYVMCTGSFKLEKEVAETQHGTVLVQVKYEGTDAPCKIPFSSQDEKGVTQNGRLVTANPIVTDKEKPVNIEAEPPFGESYIVVGAGEKALKLSWFKKGSSIGKMFEATARGARRMAILGDTAWDFGSIGGVFTSVGKLVHQIFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVSGILAQGKKTIRPQPMEHKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCVWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLVVFLLLTLGQLTWNDLIRLCIMVGANASDNMGMGTTYLALMATFRMRPMFAVGLLFRRLTSREVLLLTVGLSLVASVELPNSLDELGDGLAMGIMILKLLTDFQSHQLWAILLSLTFVKTTLSLHYAWKTMAMILSIVSLLPLCLSTTSQKTTWLPVLLGSLGCKPLTMFLITENKIWGRKSWPLNEGIMAVGIVSILLSSLLKNDVPLAGPLIAGGMLIACYVISGSSADLSLEKAAKVSWEEEAEHSGASHNILVEIQDDGTMKIKDEERDDTITILLKATLLAISGVYPMSIPATLFVWHFWQKKKQRSGVLWDTPSPPEVEKAVLDDGIYRILQRGLLGRSQVGVGVFQEGVFHTMWHVTRGAVLMYQGKRLEPSWASVKKDLISYGGGWRFQGSWNTGEEVQVIAVEPGKNPKNVQTAPGTFKTSEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLVLAPTRVVASEMAEALKGMPIRYQTTAVKSEHTGKEIVDLMCHATFTMRLLSPVRVPNYNMIIMDEAHFTDPASIAARGYISTRVGMGEAAAIFMTATPPGSVEAFPQSNAVIQDEEKDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGKAYRHAMEELPDTIETIMLLALIAVLTGGVTLFFLSGRGLGKTSIGLLCVTSSSVLLWMASVEPHWIAASIILEFFLMVLLIPEPDRQRTPQDNQLAYVVIGLLFMILTVAANEMGLLETTKKDLGIGHAAAENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIIEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVRRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEAQLIRQMESEGIFSPSELETPNLAGRVLDWLEKHGTERLRRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEDVPYLGKREDQWCGSLIGLTARATWATNIQVAINQVRRLIGNENYLDYMTSMKRFKNESDPEGALW

SEQ ID NO: 3638 - protein, 3292 aa, Artificial Sequence
  derived and/or modified protein sequence (wt) from DENV-1__JQ915079__SS-prME
SVTMLLMLLPTVLTFHLTTRGGEPHMIVSKQERGKSLLFKTSAGVNMCTLIAMDLGELCDDTMTYKCPRITETEPDDVDCWCNATETWVTYGTCSQTGEHRRDKRSVALAPHVGLGLETRTETWMSSEGAWRQIQKVETWALRHPGFTVIALFLAHAIGTSITQKGIIFILLMLVTPSMAMRCVGIGNRDFVEGLSGATWVDVVLEHGSCVTTMAKDKPTLDIELLKTEVTNPAVLRKLCIEAKISNTTTDSRCPTQGEATLVEEQDTNFVCRRTFVDRGWGNGCGLFGKGSLITCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTTGASTSQETWNRQDLLVTFKTAHAKKQEVVVLGSQEGAMHTALTGATEIQTSGTTTIFAGHLKCRLKMDKLTLKGISYVMCTGSFKLEKEVAETQHGTVLVQVKYEGTDAPCKIPFSSQDEKGVTQNGRLVTANPIVTDKERPVNIEAEPPFGESYIVVGAGEKALKLSWFKKGSSIGKMFEATARGARRMAILGDTAWDFGSIGGVFTSVGKLVHQIFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVSGILAQGKKTIRPQPMEHKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCVWPKSHTLWSNGVLESEMVIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLVVFLLLTLGQLTWNDLIRLCIMVGANASDNMGMGTTYLALMATFRMRPMFAVGLLFRRLTSREVLLLTVGLSLVASVELPNSLDELGDGLAMGIMILKLLTDFQSHQLWATLLSLTFVKTTLSLHYAWKTMAMILSIVSLLPLCLSTTSQKTTWLPVLLGSLGCKPLTMFLITENKIWGRKSWPLNEGIMAVGIVSILLSSLLKNDVPLAGPLIAGGMLIACYVISGSSADLSLEKAAKVSWEEEAEHSGASHNILVEIQDDGTMKIKDEERDDTITILLKATLLAISGVYPMSIPATLFVWHFWQKKKQRSGVLWDTPSPPEVEKAVLDDGIYRILQRGLLGRSQVGVGVFQEGVFHTMWHVTRGAVLMYQGKRLEPSWASVKKDLISYGGGWRFQGSWNMGEEVQVIAVEPGKNPKNVQTAPGTFKTSEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLVLAPTRVVASEMAEALKGMPIRYQTTAVKSEHTGKEIVDLMCHATFTMRLLSPVRVPNYNMIIMDEAHFTDPASIAARGYISTRVGMGEAAAIFMTATPPGSVEAFPQSNAVIQDEEKDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGKAYRHAMEELPDTIETIMLLALIAVLTGGVTLFFLSGRGLGKTSIGLLCVTSSSALLWMASVEPHWIAASIILEFFLMVLLIPEPDRQRTPQDNQLAYVVIGLLFMILTVAANEMGLLETTKKDLGIGHTAAENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSQFNTYKRSGIIEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVRRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEEDLQNEAKITDIMEPEHALLATSIFKLTYQNKVVRVQRPAKNGTVMDVISRRDQRGSGQVGTYGLNTFTNMEAQLIRQMESEGIFSPSELETPNLAGRVLDWLEKHGIERLRRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEDVPYLGKREDQWCGSLIGLTARATWATNIQVAINQVRRLIGNENYLDYMTSMKRFKNESDPEGALW

SEQ ID NO: 3639 - protein, 3292 aa, Artificial Sequence
  derived and/or modified protein sequence (wt) from DENV-1__JQ915080__SS-prME
SVTMLLMLLPTVLTFHLTTRGGEPHMIVSKQERGKSLLFKTSAGVNMCTLIAMDLGELCDDTMTYKCPRITETEPDDVDCWCNATETWVTYGTCSQTGEHRRDKRSVALAPHVGLGLETRTETWMSSEGAWRQIQKVETWALRHPGFTVIALFLAHAIGTSITQKGIIFILLMLVTPSMAMRCVGIGNRDFVEGLSGATWVDVVLEHGSCVTTMAKDKPTLDIELLKTEVTNPAVLRKLCIEAKISNTTTDSRCPTQGEATLVEEQDTNFVCRRTFVDRGWGNGCGLFGKGSLITCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTTGASTSQETWNRQDLLVTFKTAHAKKQEVVVLGSQEGAMHTALTGATEIQTSGTTTIFAGHLKCRLKMDKLTLKGISYVMCTGSFKLEKEVAETQHGTVLVQVKYEGTDAPCKIPFSSQDEKGVTQNGRLVTANPIVTDKERPVNIEAEPPFGESYIVVGAGEKALKLSWFKKGSSIGKMFEATARGARRMAILGDTAWDFGSIGGVFTSVGKLVHQIFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVSGILAQGKKTIRPQPMEHKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCVWPKSHTLWSNGVLESEMVIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLVVFLLLTLGQLTWNDLIRLCIMVGANASDNMGMGTTYLALMATFRMRPMFAVGLLFRRLTSREVLLLTVGLSLVASVELPNSLDELGDGLAMGIMILKLLTDFQSHQLWATLLSLTFVKTTLSLHYAWKTMAMILSIVSLLPLCLSTTSQKTTWLPVLLGSLGCKPLTMFLITENKIWGRKSWPLNEGIMAVGIVSILLSSLLKNDVPLAGPLIAGGMLIACYVISGSSADLSLEKAAKVSWEEEAEHSGASHNILVEIQDDGTMKIKDEERDDTITILLKATLLAISGVYPMSIPATLFVWHFWQKKKQRSGVLWDTPSPPEVEKAVLDDGIYRILQRGLLGRSQVGVGVFQEGVFHTMWHVTRGAVLMYQGKRLEPSWASVKKDLISYGGGWRFQGSWNMGEEVQVIAVEPGKNPKNVQTAPGTFKTSEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLVLAPTRVVASEMAEALKGMPIRYQTTAVKSEHTGKEIVDLMCHATFTMRLLSPVRVPNYNMIIMDEAHFTDPASIAARGYISTRVGMGEAAAIFMTATPPGSVEAFPQSNAVIQDEEKDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGKAYRHAMEELPDTIETIMLLALIAVLTGGVTLFFLSGRGLGKTSIGLLCVTSSSALLWMASVEPHWIAASIILEFFLMVLLIPEPDRQRTPQDNQLAYVVIGLLFIILTVAANEMGLLETTKKDLGIGHTAAENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSQFNTYKRSGIIEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVRRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEEDLQNEAKITDIMEPEHALLATSIFKLTYQNKVVRVQRPAKNGTVMDVISRRDQRGSGQVGTYGLNTFTNMEAQLIRQMESEGIFSPSELETPNLAGRVLDWLEKHGIERLRRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEDVPYLGKREDQWCGSLIGLTARATWATNIQVAINQVRRLIGNENYLDYMTSMKRFKNESDPEGALW

SEQ ID NO: 3640 - protein, 3292 aa, Artificial Sequence
  derived and/or modified protein sequence (wt) from DENV-1__KJ755855__SS-prME
SVTMLLMLMPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRAETWMSSEGAWKQIQRVETWALRHPGFTVIALFLAHAIGTSITQKGIIFILLMLVTPSMAMRCVGIGSRDFVEGLSGATWVDVELEHGSCVTTMAKDKPTLDIELLKTEVTNPAVLRKLCIEAKISNTTTDSRCPTQGEATLVEEQDANFVCRRTFVDRGWGNGCELFGKGSLLTCAKFKCVTKLEGKIVQYENLKYSVIVTVHIAAQHQVGNESTEHGTTAIITPQAPTTEIQLTDYGALTLDCSPRTGLDFNEMVLLTMKEKSWLVHKQWFLDLPLPWTSGASTSQETWNRLFLLVTFKTAHAKKQEVVVLGSQEGAMHTALTGATALQTFGTTTIFAGHLNIRLKMDKLTLKGMSYVMCTGSFKLEKEVAETQHGTILVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDLKFTVVVGDVAGILAQGKKMIRPQPMEHKYSWKNWGKAKIIGADVQNSTFIIDGPNTPECSDDQRAWNIWEVEDYGFGIFTTNIWLKLRDSYTQVCDHRLMSAAIKDSKAVHADMGYWIESEKNETWKLARASFIEVKTCTWPKSHTLWSNGVLESEMIIPKIYGGPISQHNYSPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVVSLSLGLLCISIMIEEVMRSRWSRKMLMTGTLAVFFRKIRGQLTWNDLIRLCIMVGANASDRMGTRTTYLALMATFKMRPMFSVGLLFRRLTSREVLLLTIGLSLVASVELPNSLEELGVLLAMGIMILTLLTDFQSHQLWATLLSMTFIKTTFSLHYTWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPKVEKAVLDDGIYRIMQRGLLGRSQVGVGVFQENVFHTMWHVTRGAVLMYQGKRLEPSWGRVKKDLISYGGGWGLKGSWNTGEEVQVIAVEPGKNPKNVQTAPGTFKTPEGEVGAIALDFKPGTSGSPIVNREGKIVGLYGNGVVTTSGTYVSAIAHAKASQEGPLPETEVEAFRKRNLTIMDLHPGSGKTRRYLPAIVREAIKRKMRTLILAPTRVVASEMAEALKGMPIRYQTTAVKSEHTGKEIVDLMCHATFTMRLLSPVRVPNYNMIIMDEAHFTDPSSLAARGYISTRVGMGEAAAIFMTATPPGSVEAFPQSNAVIQDEERDIPERSWNSGYEWITDFPGKTVWFVPSIKAGNDIANCLRKNGKRVIQLSRKTFDTEYQKTKNNDWDYVVTTDISEMGANFPADRVIDPRRCLNPVILKDGPERVILAGPMPVTVASANQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREKKEFAAGRRSVSGDLILEIGKLPQHLTQRAQNALDNLVMLHNSEQGGRAYRHAMEELPDTIETLMLLALIAVLTGGVTLFFLSGKGLGKAGNGLLCVMASSALLWMANVEPHWIAASIILEFFLMVLLIPEPDRQRTPQDNQLAYVVIRLLFMILTVAANEMGLLETTKKDLGIGHAAVENHHHAAMLDIDLHPASAWTLYAVATTIITPMMRHTIENTTANISLTAIANQAAILMGLDKGWPISKMDIGVPLLALGFLSQVNPLTLTAAVLMLVAHYAIIGPGLQAKATREAQKRTAAGIMKNPTIDGIVAIDLDPVVYDAKFEKQLGQIMLLILCTSQILLMRTTWALCESITLATGPLSPLWEGSPGKSWNTTIAVSMANIFRGSYLAGAGLAFSLMKSLGGGRRGTGAQGETLGEKWKRQLNQLSKTEFNTYKRSGIMEVDRSEAKEGLKRGETTKHAVSRGTAKLRWFVERNLVKPEGKVIDLGCGRGGWSYYCAGLKKVSEVRGYTKGGPGHEEPIPMATYGWDLLKRCSGKEFFFIPPEKCDSFLGDIGESSPNPTIEEGRTVRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWSFLSRNKKPRICTREEFTRKVRSNAAIGAVFVDENQWNSAKEAVEDDRFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKSIFKLTYQNKVVRVQRPAKNGTVMDVISRRDQRGSGQVGTYGLNTFTNMEAQLIRQMESEEIFSPNELETPNLAERVLDWLEKYGVERLKRMAISGDDCVVKPIDDRFATALTALNDMGKVRKDIPQWEPSKGWNDWQQVPFCSHHFHQLVMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTRVSSWEDVPYLGKREDQWCGSLIGLTARATWATNIQVAINQVRRLIGNENYSDYMTSMKRFKNESEPEGALW

SEQ ID NO: 3641 - protein, 3292 aa, Artificial Sequence
  derived and/or modified protein sequence (wt) from DENV-1__KF289073__SS-prME
SVTMLFMLLPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQKVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAVLRKLCIEAKISKTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQVKYEGTDAPCKIPISTQDEKGVTQNGRLITANPIVTDKEKPVNIETEPPFGESYIVIGAGEKALKLSWFKKGSSIGKMFEATARGARRMAILGDTAWDFGSIGGVFTSVGKLVHQVFGTAYGVLFSGVSWTMKIGIGVLLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNTTFIIDGPDTPECPDDHRAWNIWEVEDYGFGIFTTNIWLKLRDSYTQMCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVRSMVSAGSGEVDSFSLGLLCVSIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMMLKLLTDFQSHQLWTTLLSLTFIKTTLSLDYAWKTMAMVLSIVSLFPLCLSTTSQKTTWLPVLLGSFGCKPLTMFLITENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNMGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPERKKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQKALDNLVMLHNSEQGGKAYRHAMEELPDTIETLMLLALIAVLTGGVTLFFLSGKGLGKTSIGLLCVMASSALLWMASVEPHWIAASIILEFFLMVLLIPEPDRQRTPQDNQLAYVVIGLLFMILTVAANEMGLLETTKKDLGIGHVAAENHHHATMLDVDLRPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMTHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTTGWDTRITEDDLQNEAKITDIMEPEHALLATSIFKLTYQNKVVRVQRPAKSGTVMDVISRRDQRGSGQVGTYGLNTFTNMEVQLIRQMESEGIFLPSELETPNLAERVLDWLEKHGVERLKRMAISGDDCVVKPTDDRFATALTALNDMGKVRKDIPQWEPSKGWNDWQQVPFCSHHFHQLIMKDGREIVVPCRNQDELMGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEDVPYLGKREDQWCGSLIGLTARATWATNIQVAINQVRRLIGNENYLDYMTSMKRFKNESDPEGALW

SEQ ID NO: 3642 - protein, 3292 aa, Artificial Sequence
  derived and/or modified protein sequence (wt) from DENV-1__JQ915072__SS-prME
SVTMLLMLLPTVLTFHLTTRGGEPHMIVSKQERGKSLLFKTSAGVNMCTLIAMDLGELCDDTMTYKCPRITETEPDDVDCWCNATETWVTYGTCSQTGEHRRDKRSVALAPHVGLGLETRTETWMSSEGAWRQIQKVETWALRHPGFTVIALFLAHAIGTSITQKGIIFILLMLVTPSMAMRCVGIGNRDFVEGLSGATWVDVVLEHGSCVTTMAKDKPTLDIELLKTEVTNPAVLRKLCIEAKISNTTTDSRCPTQGEATLVEEQDTNFVCRRTFVDRGWGNGCGLFGKGSLITCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTTGASTSQETWNRQDLLVTFKTAHAKKQEVVVLGSQEGAMHTALTGATEIQTSGTTTIFAGHLKCRLKMDKLTLKGISYVMCTGSFKLEKEVAETQHGTVLVQVKYEGTDAPCKIPFSSQDEKGVTQNGRLVTANPIVTDKEKPVNIEAEPPFGESYIVVGAGEKALKLSWFKKGSSIGKMFEATARGARRMAILGDTAWDFGSIGGVFTSVGKLVHQIFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVSGILAQGKKTIRPQPMEHKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCVWPKSHTLWSNGVLESEMIIPKIYGGPISQHNYRPGYFTQTAGPWHLGKLELDFDLCEGTTVVVDEHCGHRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLVVFLLLTLGQLTWNDLIRLCIMVGANASDNMGMGTTYLALMATFRMRPMFAVGLLFRRLTSREVLLLTVGLSLVASVELPNSLDELGDGLAMGIMILKLLTDFQSHQLWATLLSLTFVKTTLSLHYAWKTMAMILSIVSLLPLCLSTTSQKTTWLPVLLGSLGCKPLTMFLITENKIWGRKSWPLNEGIMAVGIVSILLSSLLKNDVPLAGPLIAGGMLIACYVISGSSADLSLEKAAKVSWEEEAEHSGASHNILVEIQDDGTMKIKDEERDDTITILLKATLLAISGVYPMSIPATLFVWHFWQKKKQRSGVLWDTPSPPEVEKAVLDDGIYRILQRGLLGRSQVGVGVFQEGVFHTMWHVTRGAVLMYQGKRLEPSWASVKKDLISYGGGWRFQGSWNMGEEVQVIAVEPGKNPKNVQTAPGTFKTSEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLVLAPTRVVASEMAEALKGMPIRYQTTAVKSEHTGKEIVDLMCHATFTMRLLSPVRVPNYNMIIMDEAHFTDPASIAARGYISTRVGMGEAAAIFMTATPPGSVEAFPQSNAVIQDEEKDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGKAYRHAMEELPDTIETIMLLALIAVLTGGVTLFFLSGRGLGKTSIGLLCVTSSSALLWMASVEPHWIAASIILEFFLMVLLIPEPDRQRTPQDNQLAYVVIGLLFMILTVAANEMGLLETTKKDLGIGHTAAENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGSRRGTGAQGETLGEKWKRQLNQLSKSEFNIYKRSGIIEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVRRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEEDLQNEAKITDIMEPEHALLATSIFKLTYQNKVVRVQRPAKNGTVMDVISRRDQRGSGQVGTYGLNTFTNMEAQLIRQMESEGIFSPSELETPNLAGRVLDWLEKHGIERLRRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEDVPYLGKREDQWCGSLIGLTARATWATNIQVAIKQVRRLIGNENYLDYMTSMKRFKNESDPEGALW

SEQ ID NO: 3643 - protein, 3292 aa, Artificial Sequence
  derived and/or modified protein sequence (wt) from DENV-1__JQ915071__SS-prME
SVTMLLMLLPTVLTFHLTTRGGEPHMIVSKQERGKSLLFKTSAGVNMCTLIAMDLGELCDDTMTYKCPRITETEPDDVDCWCNATETWVTYGTCSQTGEHRRDKRSVALAPHVGLGLETRTETWMSSEGAWRQIQKVETWALRHPGFTVIALFLAHAIGTSITQKGIIFILLMLVTPSMAMRCVGIGNRDFVEGLSGATWVDVVLEHGSCVTTMAKDKPTLDIELLKTEVTNPAVLRKLCIEAKISNTTTDSRCPTQGEATLVEEQDTNFVCRRTFVDRGWGNGCGLFGKGSLITCAKFKCATKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTTGASTSQETWNRQDLLVTFKTAHAKKQEVVVLGSQEGAMHTALTGATEIQTSGTTTIFAGHLKCRLKMDKLTLKGISYVMCTGSFKLEKEVAETQHGTVLVQVKYEGTDAPCKIPFSSQDEKGVTQNGRLVTANPIVTDKERPVNIEAEPPFGESYIVVGAGEKALKLSWFKKGSSIGKMFEATARGARRMAILGDTAWDFGSIGGVFTSVGKLVHQIFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVSGILAQGKKTIRPQPMEHKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCVWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLVVFLLLTLGQLTWNDLIRLCIMVGANASDNMGMGTTYLALMATFRMRPMFAVGLLFRRLTSREVLLLTVGLSLVASVELPNSLDELGDGLAMGIMILKLLTDFQSHQLWATLLSLTFVKTTLSLHYAWKTMAMILSIVSLLPLCLSTTSQKTTWLPVLLGSLGCKPLTMFLITENKIWGRKSWPLNEGIMAVGIVSILLSSLLKNDVPLAGPLIAGGMLIACYVISGSSADLSLEKAAKVSWEEEAEHSGASHNILVEIQDDGTMKIKDEERDDTITILLKATLLAISGVYPMSIPATLFVWHFWQKKKQRSGVLWDTPSPPEVEKAVLDDGIYRILQRGLLGRSQVGVGVFQEGVFHTMWHVTRGAVLMYQGKRLEPSWASVKKDLISYGGGWRFQGSWNTGEEVQVIAVEPGKNPKNVQTAPGTFKTSEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLVLAPTRVVASEMAEALKGMPIRYQTTAVKSEHTGKEIVDLMCHATFTMRLLSPVRVPNYNMIIMDEAHFTDPASIAARGYISTRVGMGEAAAIFMTATPPGSVEAFPQSNAVIQDEEKDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSSDLILEIGKLPQHLTQRAQNALDNLVMLHNSEQGGKAYRHAMEELPDTIETIMLLALIAVLTGGVTLFFLSGRGLGKTSIGLLCVTSSSALLWMANVEPHWIAASIILEFFLMVLLIPEPDRQRTPQDNQLAYVVIGLLFMILTVAANEMGLLETTKKDLGIGHTAAENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIIEVDRSEAREGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVRRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEEDLQNEAKITDIMEPEHALLATSIFKLTYQNKVVRVQRPAKNGTVMDVISRRDQRGSGQVGTYGLNTFTNMEAQLIRQMESEGIFSPSELETPNLAGRVLDWLEKHGIERLRRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEDVPYLGKREDQWCGSLIGLTARATWATNIQVAINQVRRLIGNENYLDYMTSMKRFKNESDPEGALW

SEQ ID NO: 3644 - protein, 3292 aa, Artificial Sequence
  derived and/or modified protein sequence (wt) from DENV-1__JQ915073__SS-prME
SVTMLLMLLPTVLTFHLTTRGGEPHMIVSKQERGKSLLFKTSAGVNMCTLIAMDLGELCDDTMTYKCPRITETEPDDVDCWCNATETWVTYGTCFQTGEHRRDKRSVALAPHVGLGLETRTETWMSSEGAWRQIQKVETWALRHPGFTVIALFLAHAIGTSITQKGIIFILLMLVTPSMAMRCVGIGNRDFVEGLSGATWVDVVLEHGSCVTTMAKDKPTLDIELLKTEVTNPAVLRKLCIEAKISNTTTDSRCPTQGEATLVEEQDTNFVCRRTFVDRGWGNGCGLFGKGSLITCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTTGASTSQETWNRQDLLVTFKTAHAKKQEVVVLGSQEGAMHTALTGATEIQTSGTTTIFAGHLKCRLKMDKLTLKGISYVMCTGSFKLEKEVAETQHGTVLVQVKYEGTDAPCKIPFSSQDEKGVTQNGRLVTANPIVTDKEKPVNIEAEPPFGESYIVVGAGEKALKLSWFKKGSSIGKMFEATARGARRMAILGDTAWDFGSIGGVFTSVGKLVHQIFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVSGILAQGKKTIRPQPMEHKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCVWPKSHTLWSNGVLESEMIIPKIYGGPISQHNYRPGYFTQTAGPWHLGKLELDFDLCEGTTVVVDEHCGHRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLVVFLLLTLGQLTWNDLIRLCIMVGANASDNMGMGTTYLALMATFRMRPMFAVGLLFRRLTSREVLLLTVGLSLVASVELPNSLDELGDGLAMGIMILKLLTDFQSHQLWATLLSLTFVKTTLSLHYAWKTMAMILSIVSLLPLCLSTTSQKTTWLPVLLGSLGCKPLTMFLITENKIWGRKSWPLNEGIMAVGIVSILLSSLLKNDVPLAGPLIAGGMLIACYVISGSSADLSLEKAAKVSWEEEAEHSGASHNILVEIQDDGTMKIKDEERDDTITILLKATLLAISGVYPMSIPATLFVWHFWQKKKQRSGVLWDTPSPPEVEKAVLDDGIYRILQRGLLGRSQVGVGVFQEGVFHTMWHVTRGAVLMYQGKRLEPSWASVKKDLISYGGGWRFQGSWNTGEEVQVIAVEPGKNPKNVQTTPGTFKTSEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLVLAPTRVVASEMAEALKGMPIRYQTTAVKSEHTGKEIVDLMCHATFTMRLLSPVRVPNYNMIIMDEAHFTDPASIAARGYISTRVGMGEAAAIFMTATPPGSAEAFPQSNAVIQDEEKDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGKAYRHAMEELPDTIETIMLLALIAVLTGGVTLFFLSGRGLGKTSIGLLCVTSSSALLWMASVEPHWIAASIILEFFLMVLLIPEPDRQRTPQDNQLAYVVIGLLFMILTVAANEMGLLETTKKDLGIGHTAAENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIIEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVRRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEEDLQNEAKITDIMEPEHALLATSIFKLTYQNKVVRVQRPAKNGTVMDVISRRDQRGSGQVGTYGLNTFTNMEAQLIRQMESEGIFSPSELETPNLAGRVLDWLEKHGIERLRRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEDVPYLGKREDQWCGSLIGLTARATWATNIQVAINQVRRLIGNENYLDYMTSMKRFKNESDPEGALW

SEQ ID NO: 3645 - protein, 3292 aa, Artificial Sequence
  derived and/or modified protein sequence (wt) from DENV-1__JQ915075__SS-prME
SVTMLLMLLPTVLTFHLTTRGGEPHMIVSKQERGKSLLFKTSAGVNMCTLIAMDLGELCDDTMTYKCPRITETEPDDVDCWCNATETWVTYGTCSQTGEHRRDKRSVALAPHVGLGLETRTETWMSSEGAWRQIQKVETWALRHPGFTVIALFLAHAIGTSITQKGIIFILLMLVTPSMAMRCVGIGNRDFVEGLSGATWVDVVLEHGSCVTTMAKDKPTLDIELLKTEVTNPAVLRKLCIEAKISNTTTDSRCPTQGEATLVEEQDTNFVCRRTFVDRGWGNGCGLFGKGSLITCAKFKCATKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTTGASTSQETWNRQDLLVTFKTAHAKKQEVVVLGSQEGAMHTALTGATEIQTSGTTTIFAGHLKCRLKMDKLTLKGISYVMCTGSFKLEKEVAETQHGTVLVQVKYEGTDAPCKIPFSSQDEKGVTQNGRLVTANPIVTDKERPVNIEAEPPFGESYIVVGAGEKALKLSWFKKGSSIGKMFEATARGARRMAILGDTAWDFGSIGGVFTSVGKLVHQIFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVSGILAQGKKTIRPQPMEHKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCVWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLVVFLLLTLGQLTWNDLIRLCIMVGANASDNMGMGTTYLALMATFRMRPMFAVGLLFRRLTSREVLLLTVGLSLVASVELPNSLDELGDGLAMGIMILKLLTDFQSHQLWATLLSLTFVKTTLSLHYAWKTMAMILSIVSLFPLCLSTTSQKTTWLPVLLGSLGCKPLTMFLITENKIWGRKSWPLNEGIMAVGIVSILLSSLLKNDVPLAGPLIAGGMLIACYVISGSSADLSLEKAAKVSWEEEAEHSGASHNILVEIQDDGTMKIKDEERDDTITILLKATLLAISGVYPMSIPATLFVWHFWQKKKQRSGVLWDTPSPPEVEKAVLDDGIYRILQRGLLGRSQVGVGVFQEGVFHTMWHVTRGAVLMYQGKRLEPSWASVKKDLISYGGGWRFQGSWNTGEEVQVIAVEPGKNPKNVQTAPGIFKTSEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLVLAPTRVVASEMAEALKGMPIRYQTTAVKSEHTGKEIVDLMCHATFTMRLLSPVRVPNYNMIIMDEAHFTDPASIAARGYISTRVGMGEAAAIFMTATPPGSVEAFPQSNAVIQDEEKDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSSDLILEIGKLPQHLTQRAQNALDNLVMLHNSEQGGKAYRHAMEELPDTIETIMLLALIAVLTGGVTLFFLSGRGLGKTSIGLLCVTSSSALLWMANVEPHWIAASIILEFFLMVLLIPEPDRQRTPQDNQLAYVVIGLLFMILTVAANEMGLLETTKKDLGIGHTAAENHHHAAMLDVDLHPASAWTLYAVATTIITPMMRHTIENTTANISLTAMANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIIEVDRSEAREGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVRRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEEDLQNEAKITDIMEPEHALLATSIFKLTYQNKVVRVQRPAKNGTVMDVISRRDQRGSGQVGTYGLNTFTNMEAQLIRQMESEGIFSPSELETPNLAGRVLDWLEKHGIERLRRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEDVPYLGKREDQWCGSLIGLTARATWATNIQVAINQVRRLIGNENYLDYMTSMKRFKNESDPEGALW

SEQ ID NO: 3646 - protein, 3292 aa, Artificial Sequence
  derived and/or modified protein sequence (wt) from DENV-1__JQ915076__SS-prME
SVTMLLMLLPTVLTFHLTTRGGEPHMIVSKQERGKSLLFKTSAGVNMCTLIAMDLGELCDDTMTYKCPRITETEPDDVDCWCNATETWVTYGTCSQTGEHRRDKRSVALAPHVGLGLETRTETWMSSEGAWRQIQKVETWALRHPGFTVIALFLAHAIGTSITQKGIIFILLMLVTPSMAMRCVGIGNRDFVEGLSGATWVDVVLEHGSCVTTMAKDKPTLDIELLKTEVTNPAVLRKLCIEAKISNTTTDSRCPTQGEATLVEEQDTNFVCRRTFVDRGWGNGCGLFGKGSLITCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTTGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQVKYEGTDAPCKIPFSSQDEKGVTQNGRLVTANPIVTDKEKPVNIEAEPPFGESYIVVGAGEKALKLSWFKKGSSIGKMFEATARGARRMAILGDTAWDFGSIGGVFTSVGKLVHQIFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVSGILAQGKKTIRPQPMEHKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCVWPKSHTLWSNGVLESEMIIPKIYGGPISQHNYRPGYFTQTAGPWHLGKLELDFDLCEGTTVVVDEHCGHRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLVVFLLLTLGQLTWNDLIRLCIMVGANASDNMGMGTTYLALMATFRMRPMFAVGLLFRRLTSREVLLLTVGLSLVASVELPNSLDELGDGLAMGIMILKLLTDFQSHQLWATLLSLTFVKTTLSLHYAWKTMAMILSIVSLLPLCLSTTSQKTTWLPVLLGSLGCKPLTMFLITENKIWGRKSWPLNEGIMAVGIVSILLSSLLKNDVPLAGPLIAGGMLIACYVISGSSADLSLEKAAKVSWEEEAEHSGASHNILVEIQDDGTMKIKDEERDDTITILLKATLLAISGVYPMSIPATLFVWHFWQKKKQRSGVLWDTPSPPEVEKAVLDDGIYRILQRGLLGRSQVGVGVFQEGVFHTMWHVTRGAVLMYQGKRLEPSWASVKKDLISYGGGWRFQGSWNTGEEVQVIAVEPGKNPKNVQTAPGTFKTSEGEVGAIALDFKPGTSGSPIVNREGKIVGLYGNGVVTTSGTYVSAIAQAKTSQEGPLPEIEDEVFRKRNLTIMDLHPGSGKTRRYLPAIVREAIKRKLRTLVLAPTRVVASEMAEALKGMPIRYQTTAVKSEHTGKEIVDLMCHATFTMRLLSPVRVPNYNMIIMDEAHFTDPASIAARGYISTRVGMGEAAAIFMTATPPGSVEAFPQSNAVIQDEEKDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGKAYRHAMEELPDTIETIMLLALIAVLTGGVTLFFLSGRGLGKTSIGLLCVTSSSALLWMASVEPHWIAASIILEFFLMVLLIPEPDRQRTPQDNQLAYVVIGLLFMILTVAANEMGLLETTKKDLGIGHTAAENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNIYKRSGIIEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVRRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEEDLQNEAKITDIMEPEHALLATSIFKLTYQNKVVRVQRPAKNGTVMDVISRRDQRGSGQVGTYGLNTFTNMEAQLIRQMESEGIFSPSELETPNLAGRVLDWLEKHGIERLRRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEDVPYLGKREDQWCGSLIGLTARATWATNIQVAINQVRRLIGNENYLDYMTSMKRFKNESDPEGALW

SEQ ID NO: 3647 - protein, 3292 aa, Artificial Sequence
  derived and/or modified protein sequence (wt) from DENV-1__KF289072__SS-prME
SVTMLLMLLPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWRQIQKVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGVSYVMCTGSFKLEKEVAETQHGTVLVQVKYEGTDAPCKIPISTQDEKGVTQNGRLITANPIVTDKEKPVNIETEPPFGESYIVIGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILTQGKKMIRPQPMEHKYSWKSWGKAKIIGADTQNTTFIIDGPDTPECPDDQRAWNIWEVEDYGFGVFTTNIWLKLRDSYTQMCDHRLMSAAIKDSKAVHADMGYWIESEKNETWKLARASFIEVKTCIWPRSHTLWSNGVLESEMIIPKIYGGPISQHNYRPGYFTQTAGPWHLGKLELDFNLCEGTTVVVDEHCGNRGPSLRTTTVTGKIIHEWCCRSCTLPPLRFKGEDGCWYGMEIRPVKEKEENLVRSMVSAGSGEVDSFSLGLLCVSIMIEEVMRSRWSRKMLMTGTLAVFFLLIMGQLTWNDLIRLCIMVGANVSDRMGMGTTYLALMATFKMRPMFAVGLLFRRLTSREVLLLTIGLSLVASVELPNSLEELGDGLAMGIMMLKLLTDFQSHQLWTTLLSLTFIKTTLSLDYAWKTMAMVLSIVSLFPLCLSTTSQKTTWLPVLLGSFGCKPLTMFLITENKIWGRKSWPLNEGIMAVGIVSILLSSLLKNDVPLAGPLIAGGMLIACYVISGSSADLSLERAAEVSWEEEAEHSGASHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGAVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTAASAAQRRGRIGRNQNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVMASSVLLWMASVEPHWIAASIILEFFLMVLLIPEPDRQRTPQDNQLAYVVIGLLFMILTVAANEMGLLETTKKDLGIGHVVAENHHHATMLDIDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGRFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNIVKLHSGRDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMTHRKPTYERDVDLGAGTRHVAVEPEIANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRPKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKSGTVMDVISRRDQRGSGQVGTYGLNTFTNMEVQLIRQMESEGIFSPSELENSNLAERVLDWLEKHGVERLKRMAISGDDCVVKPTDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEDVPYLGKREDQWCGSLIGLTARATWATNIQVAINQVRRLIGNENYLDYMTSMKRFKNESDSEGALW

SEQ ID NO: 3648 - protein, 3292 aa, Artificial Sequence
  derived and/or modified protein sequence (wt) from DENV-1__JQ692085__SS-prME
SVTMLLMLLPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWRQIQKVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGVSYVMCTGSFKLEKEVAETQHGTVLVQVKYEGTDAPCKIPISTQDEKGVTQNGRLITANPIVTDKEKPVNIETEPPFGESYIVIGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILTQGKKMIRPQPMEHKYSWKSWGKAKIIGADTQNTTFIIDGPDTPECPDDQRAWNIWEVEDYGFGVFTTNIWLKLRDSYTQMCDHRLMSAAIKDSKAVHADMGYWIESEKNETWKLARASFIEVKTCIWPRSHTLWSNGVLESEMIIPKIYGGPISQHNYRPGYFTQTAGPWHLGKLELDFNLCEGTTVVVDEHCGNRGPSLRTTTVTGKIIHEWCCRSCTLPPLRFRGEDGCWYGMEIRPVKEKEENLVRSMVSAGSGEVDSFSLGLLCVSIMIEEVMRSRWSRKMLMTGTLAVFFLLIMGQLTWNDLIRLCIMVGANVSDRMGMGTTYLALMATFKMRPMFAVGLLFRRLTSREVLLLTIGLSLVASVELPNSLEELGDGLAMGIMMLKLLTDFQSHQLWTTLLSLTFIKTTLSLDYAWKTMAMVLSIVSLFPLCLSTTSQKTTWLPVLLGSFGCKPLTMFLITENKIWGRKSWPLNEGIMAVGIVSILLSSLLKNDVPLAGPLIAGGMLIACYVISGSSADLSLERAAEVSWEEEAEHSGASHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGAVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTAASAAQRRGRIGRNQNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVMASSVLLWMASVEPHWIAASIILEFFLMVLLIPEPDRQRTPQDNQLAYVVIGLLFMILTVAANEMGLLETTKKDLGIGHVVAENHHHATMLDIDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGRFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNIVKLHSGRDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMTHRKPTYERDVDLGAGTRHVAVEPEIANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRPKRGTAQIMEVTAKWLWGFLSRNKKPRICTREEFTRKVRSNAAVGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKSGTVMDVISRRDQRGSGQVGTYGLNTFTNMEVQLIRQMESEGIFSPNELENSNLAERVLDWLEKHGVERLKRMAISGDDCVVKPTDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEDVPYLGKREDQWCGSLIGLTARATWATNIQVAINQVRRLIGNENYLDYMTSMKRFKNESDSEGALW

SEQ ID NO: 3649 - protein, 3292 aa, Artificial Sequence
  derived and/or modified protein sequence (wt) from DENV-1__JQ917404__SS-prME
SVTMLLMLLPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWRQIQKVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGVSYVMCTGSFKLEKEVAETQHGTVLVQVKYEGTDAPCKIPISTQDEKGVTQNGRLITANPIVTDKEKPVNIETEPPFGESYIVIGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILTQGKKMIRPQPMEHKYSWKSWGKAKIIGADTQNTTFIIDGPDTPECPDDQRAWNIWEVEDYGFGVFTTNIWLKLRDSYTQMCDHRLMSAAIKDSKAVHADMGYWIESEKNETWKLARASFIEVKTCIWPRSHTLWSNGVLESEMIIPKIYGGPISQHNYRPGYFTQTAGPWHLGKLELDFNLCEGTTVVVDEHCGNRGPSLRTTTVTGKIIHEWCCRSCTLPPLRFRGEDGCWYGMEIRPVKEKEENLVRSMVSAGSGEVDSFSLGLLCVSIMIEEVMRSRWSRKMLMTGTLAVFFLLIMGQLTWNDLIRLCIMVGANVSDRMGMGTTYLALMATFKMRPMFAVGLLFRRLTSREVLLLTIGLSLVASVELPNSLEELGDGLAMGIMMLKLLTDFQSHQLWTTLLSLTFIKTTLSLDYAWKTMAMVLSIVSLFPLCLSTTSQKTTWLPVLLGSFGCKPLTMFLITENKIWGRKSWPLNEGIMAVGIVSILLSSLLKNDVPLAGPLIAGGMLIACYVISGSSADLSLERAAEVSWEEEAEHSGASHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTAASAAQRRGRIGRNQNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTREGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVMASSVLLWMASVEPHWIAASIILEFFLMVLLIPEPDRQRTPQDNQLAYVVIGLLFMILTVAANEMGLLETTKKDLGIGHVVAENHHHATMLDIDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGRFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNIVKLHSGRDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEIANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRPKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKSGTVMDVISRRDQRGSGQVGTYGLNTFTNMEVQLIRQMESEGIFSPSELENSNLAERVLDWLEKHGVERLKRMAISGDDCVVKPTDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVNWVPTSRTTWSIHAHHQWMTTEDMLSVWNRVWIEENPWMEDKTHVSSWEDVPYLGKREDQWCGSLIGLTARATWATNIQVAINQVRRLIGNENYLDYMTSMKRFKNESDPEGALW

SEQ ID NO: 3650 - protein, 3292 aa, Artificial Sequence
  derived and/or modified protein sequence (wt) from DENV-1__GU370048__SS-prME
SVTMLLMLMPTALAFHLTTRGGEPHMIVSKQERGKSLLFKTSAGVNMCTLIAMDLGELCEDTLTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLNFNEMVLLTMKEKSWLVHKQWFLDLPLPWTSGASTTQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPRRLSAAIGKAWEEGVCGIRSATRLENIMWKQISNELNHILLENDMKFTVVVGDVAGILAQGKKMIRPQPMEHKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLITGTLAVFFLLIMGQVTWNDLIRLCIMVGANASDRMGMGTTYLALMATFKMRPMFAVGLLFRRLTSREVLLLTIGLSLVASVELPNSLEELGDGLAMGIMILKLLTDFQPHQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKAIFKLTYQNKVVRVQRPAKNGTVMDVISRRDQRGSGQVGTYGLNTFTNMEAQLIRQMESEGIFSPSELETPNLAERVLYWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWEDVPYLGKREDQWCGSLIGLTARATWATNIQVAINQVRRLIGNENYLDYMTSMKRFKNESDPEGALW

SEQ ID NO: 3651 - protein, 3292 aa, Artificial Sequence
  derived and/or modified protein sequence (wt) from DENV-1__KM403627__SS-prME
SVTMLLMLLPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWRQIQKVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGVSYVMCTGSFKLEKEVAETQHGTVLVQVKYEGTDAPCKIPISTQDEKGVTQNGRLITANPIVTDKEKPVNIETEPPFGESYIVIGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILTQGKKMIRPQPMEHKYSWKSWGKAKIIGADIQNTTFIIDGPDTPECPDDQRAWNIWEVEDYGFGVFTTNIWLKLRDSYTQMCDHRLMSAAIKDSKAVHADMGYWIESEKNETWKLARASFIEVKTCIWPRSHTLWSNGVLESEMIIPKIYGGPISQHNYRPGYFTQTAGPWHLGKLELDFNLCEGTTVVVDEHCGNRGPSLRTTTVTGKIIHEWCCRSCTLPPLRFRGEDGCWYGMEIRPVKEKEENLVRSMVSAGSGEVDSFSLGLLCVSIMIEEVMRSRWSRKMLMTGTLAVFFLLIMGQLTWNDLIRLCIMVGANVSDRMGMGTTYLALMATFKMRPMFAVGLLFRRLTSREVLLLTIGLSLVASVELPNSLEELGDGLAMGIMMLKLLTDFQSHQLWTTLLSLTFIKTTLSLDYAWKTMAMVLSIVSLFPLCLSTTSQKTTWLPVLLGSFGCKPLTMFLITENKIWGRKSWPLNEGIMAVGIVSILLSSLLKNDVPLAGPLIAGGMLIACYVISGSSADLSLERAAEVSWEEEAEHSGASHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPASIAARGYISTRVGMGEAAAIFMTATPPGSVESFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTAASAAQRRGRIGRNQNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVMASSVLLWMASVEPHWIAASIILEFFLMVLLIPEPDRQRTPQDNQLAYVVIGLLFMILTVAANEMGLLETTKKDLGIGHVVAENHHHATMLDIDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNIVKLHSGRDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEIANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRPKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKSGTVMDVISRRDQRGSGQVGTYGLNTFTNMEVQLIRQMESEGIFSPSELENSNLAERVLDWLEKHGVERLKRMAISGDDCVVKPTDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVNWVPTSRTTWSIHAHHQWMTTEDMLSVWNRVWIEENPWMEDKTHVSSWEDVPYLGKREDQWCGSLIGLTARATWATNIQVAINQVRRLIGNENYLDYMTSMKRFKNESDPEGALW

SEQ ID NO: 3652 - protein, 3292 aa, Artificial Sequence
  derived and/or modified protein sequence (wt) from DENV-1__KM403584__SS-prME
SVTMLLMLLPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWRQIQKVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEVQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGVSYVMCTGSFKLEKEVAETQHGTVLVQVKYEGTDAPCKIPISTQDEKGVTQNGRLITANPIVTDKEKPVNIETEPPFGESYIVIGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDAYGILTQGKKMIRPQPMEHKYSWKSWGKAKIIGADTQNTTFIIDGPDTPECPDDQRAWNIWEVEDYGFGVFTTNIWLKLRDSYTQMCDHRLMSAAIKDSKAVHADMGYWIESEKNETWKLARASFIEVKTCIWPRSHTLWSNGVLESEMIIPKIYGGPISQHNYRPGYFTQTAGPWHLGKLELDFNLCEGTTVVVDEHCGNRGPSLRTTTVTGKIIHEWCCRSCTLPPLRFRGEDGCWYGMEIRPVKEKEENLVRSMVSAGSGEVDSFSLGLLCVSIMIEEVMRSRWSRKMLMTGTLAVFFLLIMGQLTWNDLIRLCIMVGANVSDRMGMGTTYLALMATFKMRPMFAVGLLFRRLTSREVLLLTIGLSLVASVELPNSLEELGDGLAMGIMMLKLLTDFQSHQLWTTLLSLTFIKTTLSLDYAWKTMAMVLSIVSLFPLCLSTTSQKTTWLPVLLGSFGCKPLTMFLITENKIWGRKSWPLNEGIMAVGIVSILLSSLLKNDVPLAGPLIAGGMLIACYVISGSSADLSLERAAEVSWEEEAEHSGASHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTAASAAQRRGRIGRNQNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVMASSVLLWMASVEPHWIAASIILEFFLMVLLIPEPDRQRTPQDNQLAYVVIGLLFMILTVAANEMGLLETTKKDLGIGHVVAENHHHATMLDIDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGRFWNTTIAVSMANIFRGSYLAGAGLAFSLMKSLGGGRRGTGAQGETLGEKWKRQLNQLSKSEFNTYKRSGIMEVDRSEAKEGMKRGETTKHAVSRGTAKLRWFVERNLVKPEGKVIDLGCGRGGWSYYCAGLKKVTEVKGYTKGGPGHEEPIPMATYGWNIVKLHSGRDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEIANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRPKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKSGTVMDVISRRDQRGSGQVGTYGLNTFTNMEVQLIRQMESEGIFSPSELENSNLAERVLDWLEKHGVERLKRMAISGDDCVVKPTDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVNWVPTSRTTWSIHAHHQWMTTEDMLSVWNRVWIEENPWMEDKTHVSSWEDVPYLGKREDQWCGSLIGLTARATWATNIQVAINQVRRLIGNENYLDYMTSMKRFKNESDPEGALW

SEQ ID NO: 3653 - protein, 3292 aa, Artificial Sequence
  derived and/or modified protein sequence (wt) from DENV-1__KM403633__SS-prME
SVTMLLMLLPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWRQIQKVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMREKSWLVHKQWFLDLPLPWTSGASTSQETWNRQDLLVTFKTAHAKKQEVVVLGSQEGAMHTALTGATEIQTSGTTTIFAGHLKCRLKMDKLTLKGVSYVMCTGSFKLEKEVAETQHGTVLVQVKYEGTDAPCKIPISTQDEKGVTQNGRLITANPIVTDKEKPVNIETEPPFGESYIVIGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILTQGKKMIRPQPMEHKYSWKSWGKAKIIGADTQNTTFIIDGPDTPECPDDQRAWNIWEVEDYGFGVFTTNIWLKLRDSYTQMCDHRLMSAAIKDSKAVHADMGYWIESEKNETWKLARASFIEVKTCIWPRSHTLWSNGVLESEMIIPKIYGGPISQHNYRPGYFTQTAGPWHLGKLELDFNLCEGTTVVVDEHCGNRGPSLRTTTVTGKIIHEWCCRSCTLPPLRFRGEDGCWYGMEIRPVKEKEENLVRSMVSAGSGEVDSFSLGLLCVSIMIEEVMRSRWSRKMLMTGTLAVFFLLIMGQLTWNDLIRLCIMVGANVSDRMGMGTTYLALMATFKMRPMFAVGLLFRRLTSREVLLLTIGLSLVASVELPNSLEELGDGLAMGIMMLKLLTDFQSHQLWTTLLSLTFIKTTLSLDYAWKTMAMVLSIVSLFPLCLSTTSQKTTWLPVLLGSFGCKPLTMFLITENKIWGRKSWPLNEGIMAVGIVSILLSSLLKNDVPLAGPLIAGGMLIACYVISGSSADLSLERAAEVSWEEEAEHSGASHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTAASAAQRRGRIGRNQNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVMASSVLLWMASVEPHWIAASIILEFFLMVLLIPEPDRQRTPQDNQLAYVVIGLLFMILTVAANEMGLLETTKKDLGIGHVVAENHHHATMLDIDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNIVKLHSGRDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEIANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRPKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKSGTVMDVISRRDQRGSGQVGTYGLNTFTNMEVQLIRQMESEGIFSPSELENSNLAERVLDWLEKHGVERLKRMAISGDDCVVKPTDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVNWVPTSRTTWSIHAHHQWMTTEDMLSVWNRVWIEENPWMEDKTHVSSWEDVPYLGKREDQWCGSLIGLTARATWATNIQVAINQVRRLIGNENYLDYMTSMKRFKNESDPEGALW

SEQ ID NO: 3654 - protein, 3292 aa, Artificial Sequence
  derived and/or modified protein sequence (wt) from DENV-1__KM403592__SS-prME
SVTMLLMLLPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWRQIQKVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGVSYVMCTGSFKLEKEVAETQHGTVLVQVKYEGTDAPCKIPISTQDEKGVAQNGRLITANPIVTDKEKPVNIETEPPFGESYIVIGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILTQGKKMIRPQPMEHKYSWKSWGKAKIIGADTQNTTFIIDGPDTPECPDDQRAWNIWEVEDYGFGVFTTNIWLKLRDSYTQMCDHRLMSAAIKDSKAVHADMGYWIESEKNETWKLARASFIEVKTCIWPRSHTLWSNGVLESEMIIPKIYGGPISQHNYRPGYFTQTAGPWHLGKLELDFNLCEGTTVVVDEHCGNRGPSLRTTTVTGKIIHEWCCRSCTLPPLRFRGEDGCWYGMEIRPVKEKEENLVRSMVSAGSGEVDSFSLGLLCVSIMIEEVMRSRWSRKMLMTGTLAVFFLLIMGQLTWNDLVRLCIMVGANVSDRMGMGTTYLALMATFKMRPMFAVGLLFRRLTSREVLLLTIGLSLVASVELPNSLEELGDGLAMGIMMLKLLTDFQSHQLWTTLLSLTFIKTTLSLDYAWKTMAMVLSIVSLFPLCLSTTSQKTTWLPVLLGSFGCKPLTMFLITENKIWGRKSWPLNEGIMAVGIVSILLSSLLKNDVPLAGPLIAGGMLIACYVISGSSADLSLERAAEVSWEEEAEHSGASHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTMPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTAASAAQRRGRIGRNQNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVMASSVLLWMASVEPHWIAASIILEFFLMVLLIPEPDRQRTPQDNQLAYVVIGLLFMILTVAANEMGLLETTKKDLGIGHVVAENHHHATMLDIDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNIVKLHSGRDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEIANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRPKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKSGTVMDVISRRDQRGSGQVGTYGLNTFTNMEVQLIRQMESEGIFSPSELENSNLAERVLDWLEKHGVERLKRMAISGDDCVVKPTDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVNWVPTSRTTWSIHAHHQWMTTEDMLSVWNRVWIEENPWMEDKTHVSSWEDVPYLGKREDQWCGSLIGLTARATWATNIQVAINQVRRLIGNENYLDYMTSMKRFKNESDPEGALW

SEQ ID NO: 3655 - protein, 3292 aa, Artificial Sequence
  derived and/or modified protein sequence (wt) from DENV-1__KM403593__SS-prME
SVTMLLMLLPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWRQIQKVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGVSYVMCTGSFKLEKEVAETQHGTVLVQVKYEGTDAPCKIPISTQDEKGVAQNGRLITANPIVTDKEKPVNIETEPPFGESYIVIGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILTQGKKMIRPQPMEHKYSWKSWGKAKIIGADTQNTTFIIDGPDTPECPDDQRAWNIWEVEDYGFGVFTTNIWLKLRDSYTQMCDHRLMSAAIKDSKAVHADMGYWIESEKNETWKLARASFIEVKTCIWPRSHTLWSNGVLESEMIIPKIYGGPISQHNYRPGYFTQTAGPWHLGKLELDFNLCEGTTVVVDEHCGNRGPSLRTTTVTGKIIHEWCCRSCTLPPLRFRGEDGCWYGMEIRPVKEKEENLVRSMVSAGSGEVDSFSLGLLCVSIMIEEVMRSRWSRKMLMTGTLAVFFLLIMGQLTWNDLIRLCIMVGANVSDRMGMGTTYLALMATFKMRPMFAVGLLFRRLTSREVLLLTIGLSLVASVELPNSLEELGDGLAMGIMMLKLLTDFQSHQLWTTLLSLTFIKTTLSLDYAWKTMAMVLSIVSLFPLCLSTTSQKTTWLPVLLGSFGCKPLTMFLITENKIWGRKSWPLNEGIMAVGIVSILLSSLLKNDVPLAGPLIAGGMLIACYVISGSSADLSLERAAEVSWEEEAEHSGASHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTAASAAQRRGRIGRNQNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVMASSVLLWMASVEPHWIAASIILEFFLMVLLIPEPDRQRTPQDNQLAYVVIGLLFMILTVAANEMGLLETTKKDLGIGHVVAENHHHATMLDIDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNIVKLHSGRDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEIANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRPKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKSGTVMDVISRRDQRGSGQVGTYGLNTFTNMEVQLIRQMESEGIFSPSELENSNLAERVLDWLEKHGVERLKRMAISGDDCVVKPTDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVNWVPTSRTTWSIHAHHQWMTTEDMLSVWNRVWIEENPWMEDKTHVSSWEDVPYLGKREDQWCGSLIGLTARATWATNIQVAINQVRRLIGNENYLDYMTSMKRFKNESDPEGALW

SEQ ID NO: 3656 - protein, 3292 aa, Artificial Sequence
  derived and/or modified protein sequence (wt) from DENV-1__KM403603__SS-prME
SVTMLLMLLPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWRQIQKVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGVSYVMCTGSFKLEKEVAETQHGTVLVQVKYEGTDAPCKIPISTQDEKGVTQNGRLITANPIVTDKEKPVNIETEPPFGESYIVIGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILTQGKKMIRPQPMEHKYSWKSWGKAKIIGADTQNTTFIIDGPDTPECPDDQRAWNIWEVEDYGFGVFTTNIWLKLRDSYTQMCDHRLMSAAIKDSKAVHADMGYWIESEKNETWKLARASFIEVKTCIWPRSHTLWSNGVLESEMIIPKIYGGPISQHNYRPGYFTQTAGPWHLGKLELDFNLCEGTTVVVDEHCGNRGPSLRTTTVTGKIIHEWCCRSCTLPPLRFRGEDGCWYGMEIRPVKEKEENLVRSMVSAGSGEVDSFSLGLLCVSIMIEEVMRSRWSRKMLMTGTLAVFFLLIMGQLTWNDLIRLCIMVGANVSDRMGMGTTYLALMATFKMRPMFAVGLLFRRLTSREVLLLTIGLSLVASVELPNSLEELGDGLAMGIMMLKLLTDFQSHQLWTTLLSLTFIKTTLSLDYAWKTMAMVLSIVSLFPLCLSTTSQKTTWLPVLLGSFGCKPLTMFLITENKIWGRKSWPLNEGIMAVGIVSILLSSLLKNDVPLAGPLIAGGMLIACYVISGSSADLSLERAAEVSWEEEAEHSGASHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTAASAAQRRGRIGRNQNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVMASSVLLWMASVEPHWIAASIILEFFLMVLLIPEPDRQRTPQDNQLAYVVIGLLFMILTVAANEMGLLETTKKDLGIGHVVAENHHHATMLDIDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKTLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNIVKLHSGRDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEIANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRPKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKSGTVMDVISRRDQRGSGQVGTYGLNTFTNMEVQLIRQMESEGIFSPSELENSNLAERVLDWLEKHGVERLKRMAISGDDCVVKPTDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVNWVPTSRTTWSIHAHHQWMTTEDMLSVWNRVWIEENPWMEDKTHVSSWEDVPYLGKREDQWCGSLIGLTARATWATNIQVAINQVRRLIGNENYLDYMTSMKRFKNESDPEGALW

SEQ ID NO: 3657 - protein, 3292 aa, Artificial Sequence
  derived and/or modified protein sequence (wt) from DENV-1__KM403585__SS-prME
SVTMLLMLLPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWRQIQKVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGRIVQYENLKYSVIVTVHTGDQHQVGNETTEHGTIATITPQAPTSEVQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGVSYVMCTGSFKLEKEVAETQHGTVLVQVKYEGTDAPCKIPISTQDEKGVTQNGRLITANPIVTDKEKPVNIETEPPFGESYIVIGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDAYGILTQGKKMIRPQPMEHKYSWKSWGKAKIIGADTQNTTFIIDGPDTPECPDDQRAWNIWEVEDYGFGVFTTNIWLKLRDSYTQMCDHRLMSAAIKDSKAVHADMGYWIESEKNETWKLARASFIEVKTCIWPRSHTLWSNGVLESEMIIPKIYGGPISQHNYRPGYFTQTAGPWHLGKLELDFNLCEGTTVVVDEHCGNRGPSLRTTTVTGKIIHEWCCRSCTLPPLRFRGEDGCWYGMEIRPVKEKEENLVRSMVSAGSGEVDSFSLGLLCVSIMIEEVMRSRWSRKMLMTGTLAVFFLLIMGQLTWNDLIRLCIMVGANVSDRMGMGTTYLALMATFKMRPMFAVGLLFRRLTSREVLLLTIGLSLVASVELPNSLEELGDGLAMGIMMLKLLTDFQSHQLWTTLLSLTFIKTTLSLDYAWKTMAMVLSIVSLFPLCLSTTSQKTTWLPVLLGSFGCKPLTMFLITENKIWGRKSWPLNEGIMAVGIVSILLSSLLKNDVPLAGPLIAGGMLIACYVISGSSADLSLERAAEVSWEEEAEHSGASHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTAASAAQRRGRIGRNQNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVMASSVLLWMASVEPHWIAASIILEFFLMVLLIPEPDRQRTPQDNQLAYVVIGLLFMILTVAANEMGLLETTKKDLGIGHVVAENHHHATMLDIDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGRFWNTTIAVSMANIFRGSYLAGAGLAFSLMKSLGGGRRGTGAQGETLGEKWKRQLNQLSKSEFNTYKRSGIVEVDRSEAKEGMKRGETTKHAVSRGTAKLRWFVERNLVKPEGKVIDLGCGRGGWSYYCAGLKKVTEVKGYTKGGPGHEEPIPMATYGWNIVKLHSGRDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEIANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRPKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKSGTVMDVISRRDQRGSGQVGTYGLNTFTNMEVQLIRQMESEGIFSPSELENSNLAERVLDWLEKHGVERLKRMAISGDDCVVKPTDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVNWVPTSRTTWSIHAHHQWMTTEDMLSVWNRVWIEENPWMEDKTHVSSWEDVPYLGKREDQWCGSLIGLTARATWATNIQVAINQVRRLIGNENYLDYMTSMKRFKNESDPEGALW

SEQ ID NO: 3658 - protein, 3292 aa, Artificial Sequence
  derived and/or modified protein sequence (wt) from DENV-1__KM403595__SS-prME
SVTMLLMLLPTALAFHLTTRGGEPHMIVSKQERGKSLLFKTSAGVNMCTLIAMDLGELCEDTMTYKCPRITEAEPDDVDCWCNATDTWVTYGTCSQTGEHRRDRRSVALAPHVGLGLETRTETWMSSEGAWRQIQRVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGVSYVMCTGSFKLEKEVAETQHGTVLVQVKYEGTDAPCKIPISTQDEKGVTQNGRLITANPIVTDKEKPVNIEIEPPFGESYIVIGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILTQGKKMIRPQPMEHKYSWKSWGKAKIIGADTQNTTFIIDGPDTPECPDDQRAWNIWEVEDYGFGVFTTNIWLKLRDSYTQMCDHRLMSAAIKDSKAVHADMGYWIESEKNETWKLARASFIEVKTCIWPRSHTLWSNGVLESEMIIPKIYGGPISQHNYRPGYFTQTAGPWHLGKLELDFNLCEGTTVVVDEHCGNRGPSLRTTTVTGKIIHEWCCRSCTLPPLRFRGEDGCWYGMEIRPVKEKEENLVRSMVSAGSGEVDSFSLGLLCVSIMIEEVMRSRWSRKMLMTGTLAIFFLLIMGQLTWNDLIRLCIMVGANVSDRMGMGTTYLALMATFKMRPMFAVGLLFRRLTSREVLLLTIGLSLVASVELPNSLEELGDGLAMGIMMLKLLTDFQSHQLWTTLLSLTFIKTTLSLDYAWKTMAMVLSIVSLFPLCLSTTSQKTTWLPVLLGSFGCKPLTMFLITENKIWGRKSWPLNEGIMAVGIVSILLSSLLKNDVPLAGPLIAGGMLIACYVISGSSADLSLERAAEVSWEEEAEHSGASHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTAASAAQRRGRIGRNQNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVMASSVLLWMASVEPHWIAASIILEFFLMVLLIPEPDRQRTPQDNQLAYVVIGLLFMILTVAANEMGLLETTKKDLGIGHVVAENHHHATMLDIDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNIVKLHSGRDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPETANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRPKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKSGTVMDVISRRDQRGSGQVGTYGLNTFTNMEVQLIRQMESEGIFSPSELENSNLAERVLDWLEKHGVERLKRMAISGDDCVVKPTDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVNWVPTSRTTWSIHAHHQWMTTEDMLSVWNRVWIEENPWMEDKTHVSSWEDVPYLGKREDQWCGSLIGLTARATWATNIQVAINQVRRLIGNENYLDYMTSMKRFKNESDPEGALW

SEQ ID NO: 3659 - protein, 3292 aa, Artificial Sequence
  derived and/or modified protein sequence (wt) from DENV-1__KM403604__SS-prME
SVTMLLMLLPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWRQIQKVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEQGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGVSYVMCTGSFKLEKEVAETQHGTVLVQVKYEGTDAPCKIPISTQDEKGVTQNGRLITANPIVTDKEKPVNIETEPPFGESYIVIGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILTQGKKMIRPQPMEHKYSWKSWGKAKIIGADTQNTTFIIDGPDTPECPDDQRAWNIWEVEDYGFGVFTTNIWLKLRDSYTQMCDHRLMSAAIKDSKAVHADMGYWIESEKNETWKLARASFIEVKTCIWPRSHTLWSNGVLESEMIIPKIYGGPISQHNYRPGYFTQTAGPWHLGKLELDFNLCEGTTVVVDEHCGNRGPSLRTTTVTGKIIHEWCCRSCTLPPLRFRGEDGCWYGMEIRPVKEKEENLVRSMVSAGSGEVDSFSLGLLCVSIMIEEVMRSRWSRKMLMTGTLAVFFLLIMGQLTWNDLIRLCIMVGANVSDRMGMGTTYLALMATFKMRPMFAVGLLFRRLTSREVLLLTIGLSLVASVELPNSLEELGDGLAMGIMMLKLLTDFQSHQLWTTLLSLTFIKTTLSLDYAWKTMAMVLSIVSLFPLCLSTTSQKTTWLPVLLGSFGCKPLTMFLITENKIWGRKSWPLNEGIMAVGIVSILLSSLLKNDVPLAGPLIAGGMLIACYVISGSSADLSLERAAEVSWEEEAEHSGASHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTAASAAQRRGRIGRNQNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVMASSVLLWMASVEPHWIAASIILEFFLMVLLIPEPDRQRTPQDNQLAYVVIGLLFMILTVAANEMGLLETTKKDLGIGHVVAENHHHATMLDIDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNIVKLHSGRDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEIANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRPKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKSGTVMDVISRRDQRGSGQVGTYGLNTFTNMEVQLIRQMESEGIFSPSELENSNLAERVLDWLEKHGVERLKRMAISGDDCVVKPTDDRFATALIALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVNWVPTSRTTWSIHAHHQWMTTEDMLSVWNRVWIEENPWMEDKTHVSSWEDVPYLGKREDQWCGSLIGLTARATWATNIQVAINQVRRLIGNENYLDYMTSMKRFKNESDPEGALW

SEQ ID NO: 3660 - protein, 3292 aa, Artificial Sequence
  derived and/or modified protein sequence (wt) from DENV-1__KM403588__SS-prME
SVTMLLMLLPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWRQIQKVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMGKLTLKGVSYVMCTGSFKLEKEVAETQHGTVLVQVKYEGTDAPCKIPISTQDEKGVTQNGRLITANPIVTDKEKPVNIETEPPFGESYIVIGAGEKALKLSWFKKGSSIGKMFEATARGARRMAILGDIAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILTQGKKMIRPQPMEHKYSWKSWGKAKIIGADTQNTTFIIDGPDTPECPDDQRAWNIWEVEDYGFGVFTTNIWLKLRDSYTQMCDHRLMSAAIRDSKAVHADMGYWIESEKNETWKLARASFIEVKTCIWPRSHTLWSNGVLESEMIIPKIYGGPISQHNYRPGYFTQTAGPWHLGKLELDFNLCEGTTVVVDEHCGNRGPSLRTTTVTGKIIHEWCCRSCTLPPLRFRGEDGCWYGMEIRPVKEKEENLVRSMVSAGSGEVDSFSLGLLCVSIMIEEVMRSRWSRKMLMTGTLAVFFLLIMGQLTWNDLIRLCIMVGANVSDRMGMGTTYLALMATFKMRPMFAVGLLFRRLTSREVLLLTIGLSLVASVELPNSLEELGDGLAMGIMMLKLLTDFQSHQLWTTLLSLTFIKTTLSLDYAWKTMAMVLSIVSLFPLCLSTTSQKTTWLPVLLGSFGCKPLTMFLITENKIWGRKSWPLNEGIMAVGIVSILLSSLLKNDVPLAGPLIAGGMLIACYVISGSSADLSLERAAEVSWEEEAEHSGASHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVAAASAAQRRGRIGRNQNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVMASSVLLWMASVEPHWIAASIILEFFLMVLLIPEPDRQRTPQDNQLAYVVIGLLFMILTVAANEMGLLETTKKDLGIGHVVAENHHHATMLDIDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNIVKLHSGRDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEIANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRPKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKSGTVMDVISRRDQRGSGQVGTYGLNTFTNMEVQLIRQMESEGIFSPSELENSNLAERVLDWLEKHGVERLKRMAISGDDCVVKPTDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVNWVPTSRTTWSIHAHHQWMTTEDMLSVWNRVWIEENPWMEDKTHVSSWEDVPYLGKREDQWCGSLIGLTARATWATNIQVAINQVRRLIGNENYLDYMTSMKRFKNESDPEGALW

SEQ ID NO: 3661 - protein, 3292 aa, Artificial Sequence
  derived and/or modified protein sequence (wt) from DENV-1__KM403605__SS-prME
SVTMLLMLLPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWRQIQKVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGVSYVMCTGSFKLEKEVAETQHGTVLVQVKYEGTDAPCKIPISIQDEKGVTQNGRLITANPIVTDKEKPVNIETEPPFGESYIVIGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILTQGKKMIRPQPMEHKYSWKSWGKAKIIGADTQNTTFIIDGPDTPECPDDQRAWNIWEVEDYGFGVFTTNIWLKLRDSYTQMCDHRLMSAAIKDSKAVHADMGYWIESEKNETWKLARASFIEVKTCIWPRSHTLWSNGVLESEMIIPKIYGGPISQHNYRPGYFTQTAGPWHLGKLELDFNLCEGTTVVVDEHCGNRGPSLRTTTVTGKIIHEWCCRSCTLPPLRFRGEDGCWYGMEIRPVKEKEENLVRSMVSAGSGEVDSFSLGLLCVSIMIEEVMRSRWSRKMLMTGTLAVFFLLIMGQLTWNDLIRLCIMVGANVSDRMGMGTTYLALMATFKMRPMFAVGLLFRRLTSREVLLLTIGLSLVASVELPNSLEELGDGLAMGIMMLKLLTDFQSHQLWTTLLSLTFIKTTLSLDYAWKTMAMVLSIVSLFPLCLSTTSQKTTWLPVLLGSFGCKPLTMFLITENKIWGRKSWPLNEGIMAVGIVSILLSSLLKNDVPLAGPLIAGGMLIACYVISGSSADLSLERAAEVSWEEEAEHSGASHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTAASAAQRRGRIGRNQNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVMASSVLLWMASVEPHWIAASIILEFFLMVLLIPEPDRQRTPQDNQLAYVVIGLLFMILTVAANEMGLLETTKKDLGIGHVVAENHHHATMLDIDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKTLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNIVKLHSGRDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEIANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRPKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKSGTVMDVISRRDQRGSGQVGTYGLNTFTNMEVQLIRQMESEGIFSPSELENSNLAERVLDWLEKHGVERLKRMAISGDDCEVKPTDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVNWVPTSRTTWSIHAHHQWMTTEDMLSVWNRVWIEENPWMEDKTHVSSWEDVPYLGKREDQWCGSLIGLTARATWATNIQVAINQVRRLIGNENYLDYMTSMKRFKNESDPEGALW

SEQ ID NO: 3662 - protein, 3292 aa, Artificial Sequence
  derived and/or modified protein sequence (wt) from DENV-1__KM403606__SS-prME
SVTMLLMLLPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWRQIQKVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTLEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGVSYVMCTGSFKLEKEVAETQHGTVLVQVKYEGTDAPCKIPISTQDEKGVTQNGRLITANPIVTDKEKPVNIETEPPFGESYIVIGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILTQGKKMIRPQPMEHKYSWKSWGKAKIIGADTQNTTFIIDGPDTPECPDDQRAWNIWEVEDYGFGVFTTNIWLKLRDSYTQMCDHRLMSAAIKDSKAVHADMGYWIESEKNETWKLARASFIEVKTCIWPRSHTLWSNGVLESEMIIPKIYGGPISQHNYRPGYFTQTAGPWHLGKLELDFNLCEGTTVVVDEHCGNRGPSLRTTTVTGKIIHEWCCRSCTLPPLRFRGEDGCWYGMEIRPVKEKEENLVRSMVSAGSGEVDSFSLGLLCVSIMIEEVMRSRWSRKMLMTGTLAVFFLLIMGQLTWNDLIRLCIMVGANVSDRMGMGTTYLALMATFKMRPMFAVGLLFRRLTSREVLLLTIGLSLVASVELPNSLEELGDGLAMGIMMLKLLTDFQSHQLWTTLLSLTFIKTTLSLDYAWKTMAMVLSIVSLFPLCLSTTSQKTTWLPVLLGSFGCKPLTMFLITENKIWGRKSWPLNEGIMAVGIVSILLSSLLKNDVPLAGPLIAGGMLIACYVISGSSADLSLERAAEVSWEEEAEHSGASHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTAASAAQRRGRIGRNQNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVMASSVLLWMASVEPHWIAASIILEFFLMVLLIPEPDRQRTPQDNQLAYVVIGLLFMILTVAANEMGLLETTKKDLGIGHVVAENHHHATMLDIDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKTLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNIVKLHSGRDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEIANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRPKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKSGTVMDVISRRDQRGSGQVGTYGLNTFTNMEVQLIRQMESEGIFSPSELENSNLAERVLDWLEKHGVERLKRMAISGDDCVVKPTDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVNWVPTSRTTWSIHAHHQWMTTEDMLSVWNRVWIEENPWMEDKTHVSSWEDVPYLGKREDQWCGSLIGLTARATWATNIQVAINQVRRLIGNENYLDYMTSMKRFKNESDPEGALW

SEQ ID NO: 3663 - protein, 3292 aa, Artificial Sequence
  derived and/or modified protein sequence (wt) from DENV-1__KM403591__SS-prME
SVTMLLMLLPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWRQIQKVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMGKLTLKGVSYVMCTGSFKLEKEVAETQHGTVLVQVKYEGTDAPCKIPISTQDEKGVTQNGRLITANPIVTDKEKPVNIETEPPFGESYIVIGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILTQGKKMIRPQPMEHKYSWKSWGKAKIIGADTQNTTFIIDGPDTPECPDDQRAWNIWEVEDYGFGVFTTNIWLKLRDSYTQMCDHRLMSAAIKDSKAVHADMGYWIESEKNETWKLARASFIEVKTCIWPRSHTLWSNGVLESEMIIPKIYGGPISQHNYRPGYFTQTAGPWHLGKLELDFNLCEGTTVVVDEHCGNRGPSLRTTTVTGKIIHEWCCRSCTLPPLRFRGEDGCWYGMEIRPVKEKEENLVRSMVSAGSGEVDSFSLGLLCVSIMIEEVMRSRWSRKMLMTGTLAVFFLLIMGQLTWNDLIRLCIMVGANVSDRMGMGTTYLALMATFKMRPMFAVGLLFRRLTSREVLLLTIGLSLVASVELPNSLEELGDGLAMGIMMLKLLTDFQSHQLWTTLLSLTFIKTTLSLDYAWKTMAMVLSIVSLFPLCLSTTSQKTTWLPVLLGSFGCKPLTMFLITENKIWGRKSWPLNEGIMAVGIVSILLSSLLKNDVPLAGPLIAGGMLIACYVISGSSADLSLERAAEVSWEEEAEHSGASHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTKRYLPAIVREAIKRKLRTLILAPTRVVASEMAEALKGMPIRYQTTAVKSEHTGKEIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTAASAAQRRGRIGRNQNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVMASSVLLWMASVEPHWIAASIILEFFLMVLLIPEPDRQRTPQDNQLAYVVIGLLFMILTVAANEMGLLETTKKDLGIGHVVAENHHHATMLDIDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNIVKLHSGRDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEIANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRPKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKSGTVMDVISRRDQRGSGQVGTYGLNTFTNMEVQLIRQMESEGIFSPSELENSNLAERVLDWLEKHGVERLKRMAISGDDCVVKPTDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVNWVPTSRTTWSIHAHHQWMTTEDMLSVWNRVWIEENPWMEDKTHVSSWEDVPYLGKREDQWCGSLIGLTARATWATNIQVAINQVRRLIGNENYLDYMTSMKRFKNESDPEGALW

SEQ ID NO: 3664 - protein, 3292 aa, Artificial Sequence
  derived and/or modified protein sequence (wt) from DENV-1__KM403607__SS-prME
SVTMLLMLLPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWRQIQKVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGVSYVMCTGSFKLEKEVAETQHGTVLVQVKYEGTDAPCKIPISIQDEKGVTQNGRLITANPIVTDKEKPVNIETEPPFGESYIVIGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILTQGKKMIRPQPMEHKYSWKSWGKAKIIGADTQNTTFIIDGPDTPECPDDQRAWNIWEVEDYGFGVFTTNIWLKLRDSYTQMCDHRLMSAAIKDSKAVHADMGYWIESEKNETWKLARASFIEVKTCIWPRSHTLWSNGVLESEMIIPKIYGGPISQHNYRPGYFTQTAGPWHLGKLELDFNLCEGTTVVVDEHCGNRGPSLRTTTVTGKIIHEWCCRSCTLPPLRFRGEDGCWYGMEIRPVKEKEENLVRSMVSAGSGEVDSFSLGLLCVSIMIEEVMRSRWSRKMLMTGTLAVFFLLIMGQLTWNDLIRLCIMVGANVSDRMGMGTTYLALMATFKMRPMFAVGLLFRRLTSREVLLLTIGLSLVASVELPNSLEELGDGLAMGIMMLKLLTDFQSHQLWTTLLSLTFIKTTLSLDYAWKTMAMVLSIVSLFPLCLSTTSQKTTWLPVLLGSFGCKPLTMFLITENKIWGRKSWPLNEGIMAVGIVSILLSSLLKNDVPLAGPLIAGGMLIACYVISGSSADLSLERAAEVSWEEEAEHSGASHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTAASAAQRRGRIGRNQNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVMASSVLLWMASVEPHWIAASIILEFFLMVLLIPEPDRQRTPQDNQLAYVVIGLLFMILTVAANEMGLLETTKKDLGIGHVVAENHHHATMLDIDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKTLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNIVKLHSGRDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEIANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRPKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKSGTVMDVISRRDQRGSGQVGTYGLNTFTNMEVQLIRQMESEGIFSPSELENSNLAERVLDWLEKHGVERLKRMAISGDDCVVKPTDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVNWVPTSRTTWSIHAHHQWMTTEDMLSVWNRVWIEENPWMEDKTHVSSWEDVPYLGKREDQWCGSLIGLTARATWATNIQVAINQVRRLIGNENYLDYMTSMKRFKNESDPEGALW

SEQ ID NO: 3665 - protein, 3292 aa, Artificial Sequence
  derived and/or modified protein sequence (wt) from DENV-1__KM403581__SS-prME
SVTMLLMLLPTALAFHLTTRGGEPHMIVSKQERGKSLLFKTSAGVNMCTLIAMDLGELCEDTMTYKCPRITEAEPDDVDCWCNATDTWVTYGTCSQTGEHRRDRRSVALAPHVGLGLETRTETWMSSEGAWRQIQRVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGVSYVMCTGSFKLEKEVAETQHGTVLVQVKYEGTDAPCKIPISTQDEKGVTQNGRLITANPIVTDKEKPVNIETEPPFGESYIVIGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILTQGKKMIRPQPMEHKYSWKSWGKAKIIGADTQNTTFIIDGPDTPECPDDQRAWNIWEVEDYGFGVFTTNIWLKLRDSYTQLCDHRLMSAAIKDSKAVHADMGYWIESEKNETWKLARASFIEVKTCIWPRSHTLWSNGVLESEMIIPKIYGGPISQHNYRPGYFTQTAGPWHLGKLELDFNLCEGTTVVVDEHCGNRGPSLRTTTVTGKIIHEWCCRSCTLPPLRFRGEDGCWYGMEIRPVKEKEENLVRSMVSAGSGEVDSFSLGLLCVSIMIEEVMRSRWSRKMLMTGTLAIFFLLIMGQLTWNDLIRLCIMVGANVSDRMGMGTTYLALMATFKMRPMFAVGLLFRRLTSREVLLLTIGLSLVASVELPNSLEELGDGLAMGIMMLKLLTDFQSHQLWTTLLSLTFIKTTLSLDYAWKTMAMVLSIVSLFPLCLSTTSQKTTWLPVLLGSFGCKPLTMFLITENKIWGRKSWPLNEGIMAVGIVSILLSSLLKNDVPLAGPLIAGGMLIACYVISGSSADLSLERAAEVSWEEEAEHSGASHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTAASAAQRRGRIGRNQNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVMASSVLLWMASVEPHWIAASIILEFFLMVLLIPEPDRQRTPQDNQLAYVVIGLLFMILTVAANEMGLLETTKKDLGIGHVVAENHHHATMLDIDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNIVKLHSGRDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEIANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRPKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKSGTVMDVISRRDQRGSGQVGTYGLNTFTNMEVQLIRQMESEGIFSPSELENSNLAERVLDWLEKHGVERLKRMAISGDDCVVKPTDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVNWVPTSRTTWSIHAHHQWMTTEDMLSVWNRVWIEENPWMEDKTHVSSWEDVPYLGKREDQWCGSLIGLTARATWATNIQVAINQVRRLIGNENYLDYMTSMKRFKNESDPEGALW

SEQ ID NO: 3666 - protein, 3292 aa, Artificial Sequence
  derived and/or modified protein sequence (wt) from DENV-1__KM403597__SS-prME
SVTMLLMLLPTALAFHLTTRGGEPHMIVSKQERGKSLLFKTSAGVNMCTLIAMDLGELCEDTMTYKCPRITEAEPDDVDCWCNATDTWVTYGTCSQTGEHRRDRRSVALAPHVGLGLETRTETWMSSEGAWRQIQRVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGVSYVMCTGSFKLEKEVAETQHGTVLVQVKYEGTDAPCKIPISTQDEKGVTQNGRLITANPIVTDKEKPVNIETEPPFGESYIVIGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILTQGKKMIRPQPMEHKYSWKSWGKAKIIGADTQNTTFIIDGPDTPECPDDQRAWNIWEVEDYGFGVFTTNIWLKLRDSYTQMCDHRLMSAAIKDSKAVHADMGYWIESEKNETWKLARASFIEVKTCIWPRSHTLWSNGVLESEMIIPKIYGGPISQHNYRPGYFTQTAGPWHLGKLELDFNLCEGTTVVVDEHCGNRGPSLRTTTVTGKIIHEWCCRSCTLPPLRFRGEDGCWYGMEIRPVKEKEENLVRSMVSAGSGEVDSFSLGLLCVSIMIEEVMRSRWSRKMLMTGTLAIFFLLIMGQLTWNDLIRLCIMVGANVSDRMGMGTTYLALMATFKMRPMFAVGLLFRRLTSREVLLLTIGLSLVASVELPNSLEELGDGLAMGIMMLKLLTDFQSHQLWTTLLSLTFIKTTLSLDYAWKTMAMVLSIVSLFPLCLSTTSQKTTWLPVLLGSFGCKPLTMFLITENKIWGRKSWPLNEGIMAVGIVSILLSSLLKNDVPLAGPLIAGGMLIACYVISGSSADLSLERAAEVSWEEEAEHSGASHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGKEIVDLICHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTAASAAQRRGRIGRNQNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVMASSVLLWMASVEPHWIAASIILEFFLMVLLIPEPDRQRTPQDNQLAYVVIGLLFMILTVAANEMGLLETTKKDLGIGHVVAENHHHATMLDIDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNIVKLHSGRDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEIANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRPKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKSGTVMDVISRRDQRGSGQVGTYGLNTFTNMEVQLIRQMESEGIFSPSELENSNLAERVLDWLEKHGVERLKRMAISGDDCVVKPTDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVNWVPTSRTTWSIHAHHQWMTTEDMLSVWNRVWIEENPWMEDKTHVSSWEDVPYLGKREDQWCGSLIGLTARATWATNIQVAINQVRRLIGNENYLDYMTSMKRFKNESDPEGALW

SEQ ID NO: 3667 - protein, 3292 aa, Artificial Sequence
  derived and/or modified protein sequence (wt) from DENV-1__KM403610__SS-prME
SVTMLLMLLPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWRQIQKVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTIHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGVSYVMCTGSFKLEKEVAETQHGTVLVQVKYEGTDAPCKIPISTQDEKGVTQNGRLITANPIVTDKEKPVNIETEPPFGESYIVIGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISSELNHILLENDMKFTVVVGDANGILTQGKKMIRPQPMEHKYSWKSWGKAKIIGADTQNTTFIIDGPDTPECPDDQRAWNIWEVEDYGFGVFTTNIWLKLRDSYTQMCDHRLMSAAIKDSKAVHADMGYWIESEKNETWKLARASFIEVKTCIWPRSHTLWSNGVLESEMIIPKIYGGPISQHNYRPGYFTQTAGPWHLGKLELDFNLCEGTTVVVDEHCGNRGPSLRTTTVTGKIIHEWCCRSCTLPPLRFRGEDGCWYGMEIRPVKEKEENLVRSMVSAGSGEVDSFSLGLLCVSIMIEEVMRSRWSKKMLMTGTLAVFFLLIMGQLTWNDLIRLCIMVGANVSDRMGMGTTYLALMATFKMRPMFAVGLLFRRLTSREVLLLTIGLSLVASVELPNSLEELGDGLAMGIMMLKLLTDFQSHQLWTTLLSLTFIKTTLSLDYAWKTMAMVLSIVSLFPLCLSTTSQKTTWLPVLLGSFGCKPLTMFLITENKIWGRKSWPLNEGIMAVGIVSILLSSLLKNDVPLAGPLIAGGMLIACYVISGSSADLSLERAAEVSWEEEAEHSGASHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTAASAAQRRGRIGRNQNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVMASSVLLWMASVEPHWIAASIILEFFLMVLLIPEPDRQRTPQDNQLAYVVIGLLFMILTVAANEMGLLETTKKDLGIGHVVAENHHHATMLDIDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNIVKLHSGRDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEIANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRPKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKSGTVMDVISRRDQRGSGQVGTYGLNTFTNMEVQLIRQMESEGIFLPSELENSNLAERVLDWLEKHGVERLKRMAISGDDCVVKPTDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVNWVPTSRTTWSIHAHHQWMTTEDMLSVWNRVWIEENPWMEDKTHVSSWEDVPYLGKREDQWCGSLIGLTARATWATNIQVAINQVRRLIGNENYLDYMTSMKRFKNESDPEGALW

SEQ ID NO: 3668 - protein, 3292 aa, Artificial Sequence
  derived and/or modified protein sequence (wt) from DENV-1__KM403596__SS-prME
SVTMLLMLLPTALAFHLTTRGGEPHMIVSKQERGKSLLFKTSAGVNMCTLIAMDLGELCEDTMTYKCPRITEAEPDDVDCWCNATDTWVTYGTCSQTGEHRRDRRSVALAPHVGLGLETRTETWMSSEGAWRQIQRVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALSLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGVSYVMCTGSFKLEKEVAETQHGTVLVQVKYEGTDAPCKIPISTQDEKGVTQNGRLITANPIVTDKEKPVNIEIEPPFGESYIVIGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILTQGKKMIRPQPMEHKYSWKSWGKAKIIGADTQNTTFIIDGPDTPECPDDQRAWNIWEVEDYGFGVFTTNIWLKLRDSYTQMCDHRLMSAAIKDSKAVHADMGYWIESEKNETWKLARASFIEVKTCIWPRSHTLWSNGVLESEMIIPKIYGGPISQHNYRPGYFTQTAGPWHLGKLELDFNLCEGTTVVVDEHCGNRGPSLRTTTVTGKIIHEWCCRSCTLPPLRFRGEDGCWYGMEIRPVKEKEENLVRSMVSAGSGEVDSFSLGLLCVSIMIEEVMRSRWSRKMLMTGTLAIFFLLIMGQLTWNDLIRLCIMVGANVSDRMGMGTTYLALMATFKMRPMFAVGLLFRRLTSREVLLLTIGLSLVASVELPNSLEELGDGLAMGIMMLKLLTDFQSHQLWTTLLSLTFIKTTLSLDYAWKTMAMVLSIVSLFPLCLSTTSQKTTWLPVLLGSFGCKPLTMFLITENKIWGRKSWPLNEGIMAVGIVSILLSSLLKNDVPLAGPLIAGGMLIACYVISGSSADLSLERAAEVSWEEEAEHSGASHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTAASAAQRRGRIGRNQNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVMASSVLLWMASVEPHWIAASIILEFFLMVLLIPEPDRQRTPQDNQLAYVVIGLLFMILTVAANEMGLLETTKKDLGIGHVVAENHHHATMLDIDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNIVKLHSGRDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPETANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRPKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKSGTVMDVISRRDQRGSGQVGTYGLNTFTNMEVQLIRQMESEGIFSPSELENSNLAERVLDWLEKHGVERLKRMAISGDDCVVKPTDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVNWVPTSRTTWSIHAHHQWMTTEDMLSVWNRVWIEENPWMEDKTHVSSWEDVPYLGKREDQWCGSLIGLTARATWATNIQVAINQVRRLIGNENYLDYMTSMKRFKNESDPEGALW

SEQ ID NO: 3669 - protein, 3292 aa, Artificial Sequence
  derived and/or modified protein sequence (wt) from DENV-1__KM403616__SS-prME
SVTMLLMLLPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWRQIQKVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVVVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGVSYVMCTGSFKLEKEVAETQHGTVLVQVKYEGTDAPCKIPISTQDEKGVTQNGRLITANPIVTDKEKPVNIETEPPFGESYIVIGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILTQGKKMIRPQPMEHKYSWKSWGKAKIIGADTQNTTFIIDGPDTPECPDDQRAWNIWEVEDYGFGVFTTNIWLKLRDSYTQMCDHRLMSAAIKDSKAVHADMGYWIESEKNETWKLARASFIEVKTCIWPRSHTLWSNGVLESEMIIPKIYGGPISQHNYRPGYFTQTAGPWHLGKLELDFNLCEGTTVVVDEHCGNRGPSLRTTTVTGKIIHEWCCRSCTLPPLRFRGEDGCWYGMEIRPVKEKEENLVRSMVSAGSGEVDSFSLGLLCVSIMIEEVMRSRWSRKMLMTGTLAAFFLLIMGQLTWNDLIRLCIMVGANVSDRMGMGTTYLALMATFKMRPMFAVGLLFRRLTSREVLLLTIGLSLVASVELPNSLEELGDGLAMGIMMLKLLTDFQSHQLWTTLLSLTFIKTTLSLDYAWKTMAMVLSIVSLFPLCLSTTSQKTTWLPVLLGSFGCKPLTMFLITENKIWGRKSWPLNEGIMAVGIVSILLSSLLKNDVPLAGPLIAGGMLIACYVISGSSADLSLERAAEVSWEEEAEHSGASHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTAASAAQRRGRIGRNQNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVMASSVLLWMASVEPHWIAASIILEFFLMVLLIPEPDRQRTPQDNQLAYVVIGLLFMILTVAANEMGLLETTKKDLGIGHVVAENHHHATMLDIDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNIVKLHSGRDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEIANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRPKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKSGTVMDVISRRDQRGSGQVGTYGLNTFTNMEVQLIRQMESEGIFSPSELENSNLAERVLDWLEKHGVERLKRMAISGDDCVVKPTDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVNWVPTSRTTWSIHAHHQWMTTEDMLSVWNRVWIEENPWMEDKTHVSSWEDVPYLGKREDQWCGSLIGLTARATWATNIQVAINQVRRLIGNENYLDYMTSMKRFKNESDPEGALW

SEQ ID NO: 3670 - protein, 3292 aa, Artificial Sequence
  derived and/or modified protein sequence (wt) from DENV-1__KM403617__SS-prME
SVTMLLMLLPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWRQIQKVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVVVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGVSYVMCTGSFKLEKEVAETQHGTVLVQVKYEGTDAPCKIPISTQDEKGVTQNGRLITANPIVTDKEKPVNIETEPPFGESYIVIGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILTQGKKMIRPQPMEHKYSWKSWGKAKIIGADTQNTTFIIDGPDTPECPDDQRAWNIWEVEDYGFGVFTTNIWLKLRDSYTQMCDHRLMSAAIKDSKAVHADMGYWIESEKNETWKLARASFIEVKTCIWPRSHTLWSNGVLESEMIIPKIYGGPISQHNYRPGYFTQTAGPWHLGKLELDFNLCEGTTVVVDEHCGNRGPSLRTTTVTGKIIHEWCCRSCTLPPLRFRGEDGCWYGMEIRPVKEKEENLVRSMVSAGSGEVDSFSLGLLCVSIMIEEVMRSRWSRKMLMTGTLAVFFLLIMGQLTWNDLIRLCIMVGANVSDRMGMGTTYLALMATFKMRPMFAVGLLFRRLTSREVLLLTIGLSLVASVELPNSLEELGDGLAMGIMMLKLLTDFQSHQLWTTLLSLTFIKTTLSLDYAWKTMAMVLSIVSLFPLCLSTTSQKTTWLPVLLGSFGCKPLTMFLITENKIWGRKSWPLNEGIMAVGIVSILLSSLLKNDVPLAGPLIAGGMLIACYVISGSSADLSLERAAEVSWEEEAEHSGASHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTAASAAQRRGRIGRNQNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVMASSVLLWMASVEPHWIAASIILEFFLMVLLIPEPDRQRTPQDNQLAYVVIGLLFMILTVAANEMGLLETTKKDLGIGHVVAENHHHATMLDIDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNIVKLHSGRDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEIANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRPKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKSGTVMDVISRRDQRGSGQVGTYGLNTFTNMEVQLIRQMESEGIFSPSELENSNLAERVLDWLEKHGVERLKRMAISGDDCVVKPTDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVNWVPTSRTTWSIHAHHQWMTTEDMLSVWNRVWIEENPWMEDKTHVSSWEDVPYLGKREDQWCGSLIGLTARATWATNIQVAINQVRRLIGNENYLDYMTSMKRFKNESDPEGALW

SEQ ID NO: 3671 - protein, 3292 aa, Artificial Sequence
  derived and/or modified protein sequence (wt) from DENV-1__KM403635__SS-prME
SVTMLLMLLPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWRQIQKVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASASQETWNRQDLLVTFKTAHAKKQEVVVLGSQEGAMHTALTGATEIQTSGTTTIFAGHLKCRLKMDKLTLKGVSYVMCTGSFKLEKEVAETQHGTVLVQVKYEGTDAPCKIPISTQDEKGVTQNGRLITANPIVTDKEKPVNIETEPPFGESYIVIGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILTQGKKMIRPQPMEHKYSWKSWGKAKIIGADTQNTTFIIDGPDTPECPDDQRAWNIWEVEDYGFGVFTTNIWLKLRDSYTQMCDHRLMSAAIKDSKAVHADMGYWIESEKNETWKLARASFIEVKTCIWPRSHTLWSNGVLESEMIIPKIYGGPISQHNYRPGYFTQTAGPWHLGKLELDFNLCEGTTVVVDEHCGNRGPSLRTTTVTGKIIHEWCCRSCTLPPLRFRGEDGCWYGMEIRPVKEKEENLVRSMVSAGSGEVDSFSLGLLCVSIMIEEVMRSRWSRKMLMTGTLAVFFLLIMGQLTWNDLIRLCIMVGANVSDRMGMGTTYLALMATFKMRPMFAVGLLFRRLTSREVLLLTIGLSLVASVELPNSLEELGDGLAMGIMMLKLLTDFQSHQLWTTLLSLTFIKTTLSLDYAWKTMAMVLSIVSLFPLCLSTTSQKTTWLPVLLGSFGCKPLTMFLITENKIWGRKSWPLNEGIMAVGIVSILLSSLLKNDVPLAGPLIAGGMLIACYVISGSSADLSLERAAEVSWEEEAEHSGASHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTAASAAQRRGRIGRNQNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVMASSVLLWMASVEPHWIAASIILEFFLMVLLIPEPDRQRTPQDNQLAYVVIGLLFMILTVAANEMGLLETTKKDLGIGHVVAENHHHATMLDIDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNIVKLHSGRDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEIANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRPKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKSGTVMDVISRRDQRGSGQVGTYGLNTFTNMEVQLIRQMESEGIFSPSELENSNLAERVLDWLEKHGVERLKRMAISGDDCVVKPTDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVNWVPTSRTTWSIHAHHQWMTTEDMLSVWNRVWIEENPWMEDKTHVSSWEDVPYLGKREDQWCGSLIGLTARATWATNIQVAINQVRRLVGNENYLDYMTSMKRFKNESDPEGALW

SEQ ID NO: 3672 - protein, 3292 aa, Artificial Sequence
  derived and/or modified protein sequence (wt) from DENV-1__KM403621__SS-prME
SVTMLLMLLPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWRQIQKVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGVSYVMCTGSFKLEKEVAETQHGTVLVQVKYEGTDAPCKIPISTQDEKGVTQNGRLITANPIVTDKEKPVNIETEPPFGESYIVIGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILTQGKKMIRPQPMEHKYSWKSWGKAKIIGADTQNTTFIIDGPDTPECPDDQRAWNIWEVEDYGFGVFTTNIWLKLRDSYTQMCDHRLMSAAIKDSKAVHADMGYWIESEKNETWKLARASFIEVKTCIWPRSHTLWSNGVLESEMIIPKIYGGPISQHNYRPGYFTQTAGPWHLGKLELDFNLCEGTTVVVDEHCGNRGPSLRTTTVTGKIIHEWCCRSCTLPPLRFRGEDGCWYGMEIRPVKEKEENLVRSMVSAGSGEVDSFSLGLLCVSIMIEEVMRSRWSRKMLMTGTLAVFFLLIMGQLTWNDLIRLCIMVGANVSDRMGMGTTYLALMATFKMRPMFAVGLLFRRLTSREVLLLTIGLSLVASVELPNSLEELGDGLAMGIMMLKLLTDFQSHQLWTTLLSLTFIKTTLSLDYAWKTMAMVLSIVSLFPLCLSTTSQKTTWLPVLLGSFGCKPLTMFLITENKIWGRKSWPLNEGIMAVGIVSILLSSLLKNDVPLAGPLIAGGMLIACYVISGSSADLSLERAAEVSWEEEAEHSGASHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPASIAARGYISTRVGMGEAAAIFMTATPPGSVESFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTAASAAQRRGRIGRNQNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVMASSVLLWMASVEPHWIAASIILEFFLMVLLIPEPDRQRTPQDNQLAYVVIGLLFMILTVAANEMGLLETTKKDLGIGHVVAENHHHATMLDIDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNIVKLHSGRDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEIANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRPKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKSGTVMDVISRRDQRGSGQVGTYGLNTFTNMEVQLIRQMESEGIFSPSELENSNLAERVLDWLEKHGVERLKRMAISGDDCVVKPTDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVNWVPTSRTTWSIHAHHQWMTTEDMLSVWNRVWIEENPWMEDKTHVSSWEDVPYLGKREDQWCGSLIGLTARATWATNIQVAINQVRRLIGNENYLDYMTSMKRFKNESDPEGALW

SEQ ID NO: 3673 - protein, 3292 aa, Artificial Sequence
  derived and/or modified protein sequence (wt) from DENV-1__KM403623__SS-prME
SVTMLLMLLPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWRQIQKVETWALRHPGFTVIAFFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGVSYVMCTGSFKLEKEVAETQHGTVLVQVKYEGTDAPCKIPISTQDEKGVTQNGRLITANPIVTDKEKPVNIETEPPFGESYIVIGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILTQGKKMIRPQPMEHKYSWKSWGKAKIIGADTQNTTFIIDGPDTPECPDDQRAWNIWEVEDYGFGVFTTNIWLKLRDSYTQMCDHRLMSAAIKDSKAVHADMGYWIESEKNETWKLARASFIEVKTCIWPRSHTLWSNGVLESEMIIPKIYGGPISQHNYRPGYFTQTAGPWHLGKLELDFNLCEGTTVVVDEHCGNRGPSLRTTTVTGKIIHEWCCRSCTLPPLRFRGEDGCWYGMEIRPVKEKEENLVRSMVSAGSGEVDSFSLGLLCVSIMIEEVMRSRWSRKMLMTGTLAVFFLLIMGQLTWNDLIRLCIMVGANVSDRMGMGTTYLALMATFKMRPMFAVGLLFRRLTSREVLLLTIGLSLVASVELPNSLEELGDGLAMGIMMLKLLTDFQSHQLWTTLLSLTFIKTTLSLDYAWKTMAMVLSIVSLFPLCLSTTSQKTTWLPVLLGSFGCKPLTMFLITENKIWGRKSWPLNEGIMAVGIVSILLSSLLKNDVPLAGPLIAGGMLIACYVISGSSADLSLERAAEVSWEEEAEHSGASHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPASIAARGYISTRVGMGEAAAIFMTATPPGSVESFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTAASAAQRRGRIGRNQNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVMASSVLLWMASVEPHWIAASIILEFFLMVLLIPEPDRQRTPQDNQLAYVVIGLLFMILTVAANEMGLLETTKKDLGIGHVVAENHHHATMLDIDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNIVKLHSGRDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEIANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRPKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKSGTVMDVISRRDQRGSGQVGTYGLNTFTNMEVQLIRQMESEGIFSPSELENSNLAERVLDWLEKHGVERLKRMAISGDDCVVKPTDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVNWVPTSRTTWSIHAHHQWMTTEDMLSVWNRVWIEENPWMEDKTHVSSWEDVPYLGKREDQWCGSLIGLTARATWATNIQVAINQVRRLIGNENYLDYMTSMKRFKNESDPEGALW

SEQ ID NO: 3674 - protein, 3292 aa, Artificial Sequence
  derived and/or modified protein sequence (wt) from DENV-1__KM403575__SS-prME
SVTMLLMLLPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWRQIQKVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGVSYVMCTGSFKLEKEVAETQHGTVLVQVKYEGTDAPCKIPISTQDEKGVTQNGRLITANPIVTDKEKPVNIETEPPFGESYIVIGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILTQGKKMIRPQPMEHKYSWKSWGKAKIIGADTQNTTFIIDGPDTPECPDDQRAWNIWEVEDYGFGVFTTNIWLKLRDSYTQMCDHRLMSAAIKDSKAVHADMGYWIESEKNETWKLARASFIEVKTCIWPRSHTLWSNGVLESEMIIPKIYGGPISQHNYRPGYFTQTAGPWHLGKLELDFNLCEGTTVVVDEHCGNRGPSLRTTTVTGKIIHEWCCRSCTLPPLRFRGEDGCWYGMEIRPVKEKEENLVRSMVSAGSGEVDSFSLGLLCVSIMIEEVMRSRWSRKMLMTGTLAVFFLLIMGQLTWNDLIRLCIMVGANVSDRMGMGTTYLALMATFKMRPMFAVGLLFRRLTSREVLLLTIGLSLVASVELPNSLEELGDGLAMGIMMLKLLTDFQSHQLWTTLLSLTFIKTTLSLDYAWKTMAMVLSIVSLFPLCLSTTSQKTTWLPVLLGSFGCKPLTMFLITENKIWGRKSWPLNEGIMAVGIVSILLSSLLKNDVPLAGPLIAGGMLIACYVISGSSADLSLERAAEVSWEEEAEHSGASHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTAASAAQRRGRIGRNQNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVMASSVLLWMASVEPHWIAASIILEFFLMVLLIPEPDRQRTPQDNQLAYVVIGLLFMILTVAANEMGLLETTKKDLGIGHVVAENHHHATMLDIDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNIVKLHSGRDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEIANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRPKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKSGTVMDVISRRDQRGSGQVGTYGLNTFTNMEVQLIRQMESEGIFSPSELENSNLAERVLDWLEKHGVERLKRMAISGDDCVVKPTDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVNWVPTSRTTWSIHAHHQWMTTEDMLSVWNRVWIEENPWMEDKTHVSSWEDVPYLGKREDQWCGSLIGLTARATWATNIQVAINQVRRLIGNENYLDYMTSMKRFKNESDPEGALW

SEQ ID NO: 3675 - protein, 3292 aa, Artificial Sequence
  derived and/or modified protein sequence (wt) from DENV-1__KM403586__SS-prME
SVTMLLMLLPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWRQIQKVETWALRHPGFTVIAFFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEVQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGVSYVMCTGSFKLEKEVAETQHGTVLVQVKYEGTDAPCKIPISTQDEKGVTQNGRLITANPIVTDKEKPVNIETEPPFGESYIVIGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDAYGILTQGKKMIRPQPMEHKYSWKSWGKAKIIGADTQNTTFIIDGPDTPECPDDQRAWNIWEVEDYGFGVFTTNIWLKLRDSYTQMCDHRLMSAAIKDSKAVHADMGYWIESEKNETWKLARASFIEVKTCIWPRSHTLWSNGVLESEMIIPKIYGGPISQHNYRPGYFTQTAGPWHLGKLELDFNLCEGTTVVVDEHCGNRGPSLRTTTVTGKIIHEWCCRSCTLPPLRFRGEDGCWYGMEIRPVKEKEENLVRSMVSAGSGEVDSFSLGLLCVSIMIEEVMRSRWSRKMLMTGTLAVFFLLIMGQLTWNDLIRLCIMVGANVSDRMGMGTTYLALMATFKMRPMFAVGLLFRRLTSREVLLLTIGLSLVASVELPNSLEELGDGLAMGIMMLKLLTDFQSHQLWTTLLSLTFIKTTLSLDYAWKTMAMVLSIVSLFPLCLSTTSQKTTWLPVLLGSFGCKPLTMFLITENKIWGRKSWPLNEGIMAVGIVSILLSSLLKNDVPLAGPLIAGGMLIACYVISGSSADLSLERAAEVSWEEEAEHSGASHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTAASAAQRRGRIGRNQNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVMASSVLLWMASVEPHWIAASIILEFFLMVLLIPEPDRQRTPQDNQLAYVVIGLLFMILTVAANEMGLLETTKKDLGIGHVVAENHHHATMLDIDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGRFWNTTIAVSMANIFRGSYLAGAGLAFSLMKSLGGGRRGTGAQGETLGEKWKRQLNQLSKSEFNTYKRSGIMEVDRSEAKEGMKRGETTKHAVSRGTAKLRWFVERNLVKPEGKVIDLGCGRGGWSYYCAGLKKVTEVKGYTKGGPGHEEPIPMATYGWNIVKLHSGRDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEIANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRPKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKSGTVMDVISRRDQRGSGQVGTYGLNTFTNMEVQLIRQMESEGIFSPSELENSNLAERVLDWLEKHGVERLKRMAISGDDCVVKPTDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVNWVPTSRTTWSIHAHHQWMTTEDMLSVWNRVWIEENPWMEDKTHVSSWEDVPYLGKREDQWCGSLIGLTARATWATNIQVAINQVRRLIGNENYLDYMTSMKRFKNESDPEGALW

SEQ ID NO: 3676 - protein, 3292 aa, Artificial Sequence
  derived and/or modified protein sequence (wt) from DENV-1__KM403602__SS-prME
SVTMLLMLLPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWRQIQKVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGAITLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGVSYVMCTGSFKLEKEVAETQHGTVLVQVKYEGTDAPCKIPISTQDEKGVTQNGRLITANPIVTDKEKPVNIETEPPFGESYIVIGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISSELNHILLENDMKFTVVVGDANGILTQGKKMIRPQPMEHKYSWKSWGKAKIIGADTQNTTFIIDGPDTPECPDDQRAWNIWEVEDYGFGVFTTNIWLKLRDSYTQMCDHRLMSAAIKDSKAVHADMGYWIESEKNETWKLARASFIEVKTCIWPRSHTLWSNGVLESEMIIPKIYGGPISQHNYRPGYFTQTAGPWHLGKLELDFNLCEGTTVVVDEHCGNRGPSLRTTTVTGKIIHEWCCRSCTLPPLRFRGEDGCWYGMEIRPVKEKEENLVRSMVSAGSGEVDSFSLGLLCVSIMIEEVMRSRWSKKMLMTGTLAVFFLLIMGQLTWNDLIRLCIMVGANVSDRMGMGTTYLALMATFKMRPMFAVGLLFRRLTSREVLLLTIGLSLVASVELPNSLEELGDGLAMGIMMLKLLTDFQSHQLWTTLLSLTFIKTTLSLDYAWKTMAMVLSIVSLFPLCLSTTSQKTTWLPVLLGSFGCKPLTMFLITENKIWGRKSWPLNEGIMAVGIVSILLSSLLKNDVPLAGPLIAGGMLIACYVISGSSADLSLERAAEVSWEEEAEHSGASHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTAASAAQRRGRIGRNQNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVMASSVLLWMASVEPHWIAASIILEFFLMVLLIPEPDRQRTPQDNQLAYVVIGLLFMILTVAANEMGLLETTKKDLGIGHVVAENHHHATMLDIDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNIVKLHSGRDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEIANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRPKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKSGTVMDVISRRDQRGSGQVGTYGLNTFTNMEVQLIRQMESEGIFSPSELENSNLAERVLDWLEKHGVERLKRMAISGDDCVVKPTDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVNWVPTSRTTWSIHAHHQWMTTEDMLSVWNRVWIEENPWMEDKTHVSSWEDVPYLGKREDQWCGSLIGLTARATWATNIQVAINQVRRLIGNENYLDYMTSMKRFKNESDPEGALW

SEQ ID NO: 3677 - protein, 3292 aa, Artificial Sequence
  derived and/or modified protein sequence (wt) from DENV-1__KM403582__SS-prME
SVTMLLMLLPTALAFHLTTRGGEPHMIVSKQERGKSLLFKTSAGVNMCTLIAMDLGELCEDTMTYKCPRITEAEPDDVDCWCNATDTWVTYGTCSQTGEHRRDRRSVALAPHVGLGLETRTETWMSSEGAWRQIQRVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGVSYVMCTGSFKLEKEVAETQHGTVLVQVKYEGTDAPCKIPISTQDEKGVTQNGRLITANPIVTDKEKPVNIETEPPFGESYIVIGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSTTRLENIMWKQISNELNHILLENDMKFTVVVGDANGILTQGKKMIRPQPMEHKYSWKSWGKAKIIGADTQNTTFIIDGPDTPECPDDQRAWNIWEVEDYGFGVFTTNIWLKLRDSYTQMCDHRLMSAAIKDSKAVHADMGYWIESEKNETWKLARASFIEVKTCIWPRSHTLWSNGVLESEMVIPKIYGGPISQHNYRPGYFTQTAGPWHLGKLELDFNLCEGTTVVVDEHCGNRGPSLRTTTVTGKIIHEWCCRSCTLPPLRFRGEDGCWYGMEIRPVKEKEENLVRSMVSAGSGEVDSFSLGLLCVSIMIEEVMRSRWSRKMLMTGTLAIFFLLIMGQLTWNDLIRLCIMVGANVSDRMGMGTTYLALMATFKMRPMFAVGLLFRRLTSREVLLLTIGLSLVASVELPNSLEELGDGLAMGIMMLKLLTDFQSHQLWTTLLSLTFIKTTLSLDYAWKTMAMVLSIVSLFPLCLSTTSQKTTWLPVLLGSFGCKPLTMFLITENKIWGRKSWPLNEGIMAVGIVSILLSSLLKNDVPLAGPLIAGGMLIACYVISGSSADLSLERAAEVSWEEEAEHSGASHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTAASAAQRRGRIGRNQNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVMASSVLLWMASVEPHWIAASIILEFFLMVLLIPEPDRQRTPQDNQLAYVVIGLLFMILTVAANEMGLLETTKKDLGIGHVVAENHHHATMLDIDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNIVKLHSGRDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPETANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRPKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKSGTVMDVISRRDQRGSGQVGTYGLNTFTNMEVQLIRQMESEGIFSPSELENSNLAERVLDWLEKHGVERLKRMAISGDDCVVKPTDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVNWVPTSRTTWSIHAHHQWMTTEDMLSVWNRVWIEENPWMEDKTHVSSWEDVPYLGKREDQWCGSLIGLTARATWATNIQVAINQVRRLIGNENYLDYMTSMKRFKNESDPEGALW

SEQ ID NO: 3678 - protein, 3292 aa, Artificial Sequence
  derived and/or modified protein sequence (wt) from DENV-1__KM403577__SS-prME
SVTMLLMLLPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWRQIQKVETWALRHPGFTVIAFFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGVSYVMCTGSFKLEKEVAETQHGTVLVQVKYEGTDAPCKIPISTQDEKGVTQNGRLITANPIVTDKEKPVNIETEPPFGESYIVIGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILTQGKKMIRPQPMEHKYSWKSWGKAKIIGADTQNTTFIIDGPDTPECPDDQRAWNIWEVEDYGFGVFTTNIWLKLRDSYTQMCDHRLMSAAIKDSKAVHADMGYWIESEKNETWKLARASFIEVKTCIWPRSHTLWSNGVLESEMIIPKIYGGPISQHNYRPGYFTQTAGPWHLGKLELDFNLCEGTTVVVDEHCGNRGPSLRTTTVTGKIIHEWCCRSCTLPPLRFRGEDGCWYGMEIRPVKEKEENLVRSMVSAGSGEVDSFSLGLLCVSIMIEEVMRSRWSRKMLMTGTLAVFFLLIMGQLTWNDLIRLCIMVGANVSDRMGMGTTYLALMATFKMRPMFAVGLLFRRLTSREVLLLTIGLSLVASVELPNSLEELGDGLAMGIMMLKLLTDFQSHQLWTTLLSLTFIKTTLSLDYAWKTMAMVLSIVSLFPLCLSTTSQKTTWLPVLLGSFGCKPLTMFLITENKIWGRKSWPLNEGIMAVGIVSILLSSLLKNDVPLAGPLIAGGMLIACYVISGSSADLSLERAAEVSWEEEAEHSGASHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTAASAAQRRGRIGRNQNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVMASSVLLWMASVEPHWIAASIILEFFLMVLLIPEPDRQRTPQDNQLAYVVIGLLFMILTVAANEMGLLETTKKDLGIGHVVAENHHHATMLDIDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNIVKLHSGRDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEIANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRPKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKSGTVMDVISRRDQRGSGQVGTYGLNTFTNMEVQLIRQMESEGIFSPSELENSNLAERVLDWLEKHGVERLKRMAISGDDCVVKPTDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVNWVPTSRTTWSIHAHHQWMTTEDMLSVWNRVWIEENPWMEDKTHVSSWEDVPYLGKREDQWCGSLIGLTARATWATNIQVAINQVRRLIGNENYLDYMTSMKRFKNESDPEGALW

SEQ ID NO: 3679 - protein, 3292 aa, Artificial Sequence
  derived and/or modified protein sequence (wt) from DENV-1__KM403631__SS-prME
SVTMLLMLLPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWRQIQKVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGVSYVMCTGSFKLEKEVAETQHGTVLVQVKYEGTDAPCKIPISTQDEKGVTQNGRLITANPIVTDKEKPINIETEPPFGESYIVIGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILTQGKKMIRPQPMEHKYSWKSWGKAKIIGADTQNTTFIIDGPDTPECPDDQRAWNIWEVEDYGFGVFTTNIWLKLRDSYTQMCDHRLMSAAIKDSKAVHADMGYWIESEKNETWKLARASFIEVKTCIWPRSHTLWSNGVLESEMIIPKIYGGPISQHNYRPGYFTQTAGPWHLGKLELDFNLCEGTTVVVDEHCGNRGPSLRTTTVTGKIIHEWCCRSCTLPPLRFRGEDGCWYGMEIRPVKEKEENLVRSMVSAGSGEVDSFSLGLLCVSIMIEEVMRSRWSRKMLMTGTLAVFFLLIMGQLTWNDLIRLCIMVGANVSDRMGMGTTYLALMATFKMRPMFAVGLLFRRLTSREVLLLTIGLSLVASVELPNSLEELGDGLAMGIMMLKLLTDFQSHQLWTTLLSLTFIKTTLSLDYAWKTMAMVLSIVSLFPLCLSTTSQKTTWLPVLLGSFGCKPLTMFLITENKIWGRKSWPLNEGIMAVGIVSILLSSLLKNDVPLAGPLIAGGMLIACYVISGSSADLSLERAAEVSWEEEAEHSGASHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTAASAAQRRGRIGRNQNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVMASSVLLWMASVEPHWIAASIILEFFLMVLLIPEPDRQRTPQDNQLAYVVIGLLFMILTVAANEMGLLETTKKDLGIGHVVAENHHHATMLDIDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNIVKLHSGRDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEIANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRPKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKSGTVMDVISRRDQRGSGQVGTYGLNTFTNMEVQLIRQMESEGIFSPSELENSNLAERVLDWLEKHGVERLKRMAISGDDCVVKPTDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVNWVPTSRTTWSIHAHHQWMTTEDMLSVWNRVWIEENPWMEDKTHVSSWEDVPYLGKREDQWCGSLIGLTARATWATNIQVAINQVRRLIGNENYLDYMTSMKRFKNESDPEGALW

SEQ ID NO: 3680 - protein, 3292 aa, Artificial Sequence
  derived and/or modified protein sequence (wt) from DENV-1__KM403632__SS-prME
SVTMLLMLLPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWRQIQKVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFRCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGVSYVMCTGSFKLEKEVAETQHGTVLVQVKYEGTDAPCKIPISTQDEKGVTQNGRLITANPIVTDKEKPVNIETEPPFGESYIVIGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILTQGKKMIRPQPMEHKYSWKSWGKAKIIGADTQNTTFIIDGPDTPECPDDQRAWNIWEVEDYGFGVFTTNIWLKLRDSYTQMCDHRLMSAAIKDSKAVHADMGYWIESEKNETWKLARASFIEVKTCIWPRSHTLWSNGVLESEMIIPKIYGGPISQHNYRPGYFTQTAGPWHLGKLELDFNLCEGTTVVVDEHCGNRGPSLRTTTVTGKIIHEWCCRSCTLPPLRFRGEDGCWYGMEIRPVKEKEENLVRSMVSAGSGEVDSFSLGLLCVSIMIEEVMRSRWSRKMLMTGTLAVFFLLIMGQLTWNDLIRLCIMVGANVSDRMGMGTTYLALMATFKMRPMFAVGLLFRRLTSREVLLLTIGLSLVASVELPNSLEELGDGLAMGIMMLKLLTDFQSHQLWTTLLSLTFIKTTLSLDYAWKTMAMVLSIVSLFPLCLSTTSQKTTWLPVLLGSFGCKPLTMFLITENKIWGRKSWPLNEGIMAVGIVSILLSSLLKNDVPLAGPLIAGGMLIACYVISGSSADLSLERAAEVSWEEEAEHSGASHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTAASAAQRRGRIGRNQNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVMASSVLLWMASVEPHWIAASIILEFFLMVLLIPEPDRQRTPQDNQLAYVVIGLLFMILTVAANEMGLLETTKKDLGIGHVVAENHHHATMLDIDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNIVKLHSGRDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEIANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRPKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKSGTVMDVISRRDQRGSGQVGTYGLNTFTNMEVQLIRQMESEGIFSPSELENSNLAERVLDWLEKHGVERLKRMAISGDDCVVKPTDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVNWVPTSRTTWSIHAHHQWMTTEDMLSVWNRVWIEENPWMEDKTHVSSWEDVPYLGKREDQWCGSLIGLTARATWATNIQVAINQVRRLIGNENYLDYMTSMKRFKNESDPEGALW

SEQ ID NO: 3681 - protein, 3292 aa, Artificial Sequence
  derived and/or modified protein sequence (wt) from DENV-1__KM403583__SS-prME
SVTMLLMLLPTALAFHLTTRGGEPHMIVSKQERGKSLLFKTSAGVNMCTLIAMDLGELCEDTMTYKCPRITEAEPDDVDCWCNATDTWVTYGTCSQTGEHRRDRRSVALAPHVGLGLETRTETWMSSEGAWRQIQRVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGVSYVMCTGSFKLEKEVAETQHGTVLVQVKYEGTDAPCKIPISTQDEKGVTQNGRLITANPIVTDKEKPVNIETEPPFGESYIVIGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILTQGKKMIRPQPMEHKYSWKSWGKAKIIGADTQNTTFIIDGPDTPECPDDQRAWNIWEVEDYGFGVFTTNIWLKLRDSYTQMCDHRLMSAAIKDSKAVHADMGYWIESEKNETWKLARASFIEVKTCIWPRSHTLWSNGVLESEMIIPKIYGGPISQHNYRPGYFTQTAGPWHLGKLELDFNLCEGTTVVVDEHCGNRGPSLRTTTVTGKIIHEWCCRSCTLPPLRFRGEDGCWYGMEIRPVKEKEENLVRSMVSAGSGEVDSFSLGLLCVSIMIEEVMRSRWSRKMLMTGTLAIFFLLIMGQLTWNDLIRLCIMVGANVSDRMGMGTTYLALMATFKMRPMFAVGLLFRRLTSREVLLLTIGLSLVASVELPNSLEELGDGLAMGIMMLKLLTDFQSHQLWTTLLSLTFIKTTLSLDYAWKTMAMVLSIVSLFPLCLSTTSQKTTWLPVLLGSFGCKPLTMFLITENKIWGRKSWPLNEGIMAVGIVSILLSSLLKNDVPLAGPLIAGGMLIACYVISGSSADLSLERAAEVSWEEEAEHSGASHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTAASAAQRRGRIGRNQNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVMASSVLLWMASVEPHWIAASIILEFFLMVLLIPEPDRQRTPQDNQLAYVVIGLLFMILTVAANEMGLLETTKKDLGIGHVVAENHHHATMLDIDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNIVKLHSGRDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEIANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRPKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKSGTVMDVISRRDQRGSGQVGTYGLNTFTNMEVQLIRQMESEGIFSPSELENSNLAERVLDWLEKHGVERLKRMAISGDDCVVKPTDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVNWVPTSRTTWSIHAHHQWMTTEDMLSVWNRVWIEENPWMEDKTHVSSWEDVPYLGKREDQWCGSLIGLTARATWATNIQVAINQVRRLIGNENYLDYMTSMKRFKNESDPEGALW

SEQ ID NO: 3682 - protein, 3292 aa, Artificial Sequence
  derived and/or modified protein sequence (wt) from DENV-1__KM403579__SS-prME
SVTMLLMLLPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWRQIQKVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGVSYVMCTGSFKLEKEVAETQHGTVLVQVKYEGTDAPCKIPISTQDEKGVTQNGRLITANPIVTDKEKPVNIETEPPFGESYIVIGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILTQGKKMIRPQPMEHKYSWKSWGKAKIIGADIQNTTFIIDGPDTPECPDDQRAWNIWEVEDYGFGVFTTNIWLKLRDSYTQMCDHRLMSAAIKDSKAVHADMGYWIESEKNETWKLARASFIEVKTCIWPRSHTLWSNGVLESEMIIPKIYGGPISQHNYRPGYFTQTAGPWHLGKLELDFNLCEGTTVVVDEHCGNRGPSLRTTTVTGKIIHEWCCRSCTLPPLRFRGEDGCWYGMEIRPVKEKEENLVRSMVSAGSGEVDSFSLGLLCVSIMIEEVMRSRWSRKMLMTGTLAVFFLLIMGQLTWNDLIRLCIMVGANVSDRMGMGTTYLALMATFKMRPMFAVGLLFRRLTSREVLLLTIGLSLVASVELPNSLEELGDGLAMGIMMLKLLTDFQSHQLWTTLLSLTFIKTTLSLDYAWKTMAMVLSIVSLFPLCLSTTSQKTTWLPVLLGSFGCKPLTMFLITENKIWGRKSWPLNEGIMAVGIVSILLSSLLKNDVPLAGPLIAGGMLIACYVISGSSADLSLERAAEVSWEEEAEHSGASHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTAASAAQRRGRIGRNQNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVMASSVLLWMASVEPHWIAASIILEFFLMVLLIPEPDRQRTPQDNQLAYVVIGLLFMILTVAANEMGLLETTKKDLGIGHVVAENHHHATMLDIDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNIVKLHSGRDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEIANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRPKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKSGTVMDVISRRDQRGSGQVGTYGLNTFTNMEVQLIRQMESEGIFSPSELGNSNLAERVLDWLEKHGVERLKRMAISGDDCVVKPTDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVNWVPTSRTTWSIHAHHQWMTTEDMLSVWNRVWIEENPWMEDKTHVSSWEDVPYLGKREDQWCGSLIGLTARATWATNIQVAINQVRKLIGNENYLDYMTSMKRFKNESDPEGALW

SEQ ID NO: 3683 - protein, 3292 aa, Artificial Sequence
  derived and/or modified protein sequence (wt) from DENV-1__HM469968__SS-prME
SVTMLLMLMPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGALLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKYGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKAIFKLTYQNKVVRVQRPAKNGTVMDVISRRDQRGSGQVGTYGLNTFTNMEAQLIRQMESEGIFLPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWEDVPYLGKREDQWCGSLIGLTARATWATNIQVAINQVRRLIGNENYLDYMTSMKRFKNESDPEGALW

SEQ ID NO: 3684 - protein, 3292 aa, Artificial Sequence
  derived and/or modified protein sequence (wt) from DENV-1__KC172834__SS-prME
SVTMLLMLMPTALAFHLTTRGGEPHMIVSKQERGKSLLFKTSAGVNMCTLIAMDLGELCEDTMTYKCPRITEAEPDDVDCWCNATDTWVTYGTCSQAGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNSTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRFQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSMEAFPQSNAVIQDEERDIPERSWNLGHEWITDFPGKTVWFVPSIKAGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVILHNSEQGGRAYRHAMEELPDTIETLMLLALIAVLTGGVTLFFLSGKGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTIDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFVPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDDRFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKSIFKLTYQNKVVRVQRPAKNGTVMDVISRRDQRGSGQVGTYGLNTFTNMEAQLIRQMESEGIFSPNELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWGLRETACLGKSYAQMWQLMYFHRRDLRLAANAICSAVPVDWVPTSRTTWSIHAHHQWMTTEDMLSVWNRVWIEENPWMEDKTRISSWEDVPYLGKREDQWCGSLIGLTARATWATNIQVAINQVRRLIGNENYSDYMTSMKRFKNESEPEGALW

SEQ ID NO: 3685 - protein, 3292 aa, Artificial Sequence
  derived and/or modified protein sequence (wt) from DENV-1__KJ933413__SS-prME
SVTMLLMLLPTALAFHLTTRGGEPHMIVSKQERGKSLLFKTSTGVNMCTLIAMDLGELCEDTMTYKCPRITETEPDDVDCWCNATETWVTYGTCSQTGEHRRDKRSVALAPHVGLGLETRTETWMSSEGAWRQIQKVETWALRHPGFTVIALFLAHAIGTSITQKGIIFILLMLVTPSMAMRCVGIGNRDFVEGLSGATWVDVVLEHGSCVTTMAKDKPTLDIELLKTEVTNPAVLRKLCIEAKISNTTTDSRCPTQGEATLVEEQDTNFVCRRTLVDRGWGNGCGLFGKGSLITCAKFKCVTKLEGKIVQYENLKYSVIVTVHTGDQHQVGNETTEHGTTATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGVSYVMCTGSFKLEKEVAETQHGTVLVQVKYEGTDAPCKIPFTSQDEKGVTQNGRLITANPIVTDKEKPVNIEAEPPFGESYLVVGAGEKALKLSWFKKGSSIGKMFEATARGARRMAILGDTAWDFGSIGGVFTSVGKLIHQIFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSVTRLENIMWKQISNELNHILLENDMKFTVVVGDVNGILAQGKKMIRPQPMEHKYSWKSWGKAKVIGADVQNSTFIIDGPNTPECPDDQRAWNIWEVEDYGFGIFTTNIWLKLRDSYTQVCDHRLMSAAIKDSKAVHADMGYWIESEKNETWKLTRASFIEVKTCVWPKSHTLWSNGVLESEMIIPKIYGGPISQHNYRPGYFTQTAGPWHLGKLELDFGLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFLLLIMGQLTWNDLIRLCIMVGANASDKMGMGTTYLALMATFRMRPMFAVGLLFRRLTSREVLLLTVGLSLVASVELPNSLEELGDGLAMGIMMLKLLTDFQSHQLWAALLSLTFVKTTFSLHYAWKTMAMILSIVSLFPLCLSTTSQKTTWLPVLLGSLGCKPLTMFLITENRIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAISGVYPMSIPATLFVWYFWQKKKQRSGVLWDTPSPPEVERAVLDDGIYRILQRGLLGKSQVGVGVFQEGVFHTMWHVTRGAVLMYQGKRLEPSWASVKKDLISYGGGWRFQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLVLAPTRVVASEMAEALKGMPIRYQTTAVKSEHTGKEIVDLMCHATFTMRLLSPVRVPNYNMIIMDEAHFTDPASIAARGYISTRVGMGEAAAIFMTATPPGSMEAFPQSNAAIQDEERDIPERSWNSGYDWITDFPGKTVWFVPSIKSGNDIANCLRKNGKRVVQLSRKTFDTEYQKTKNNDWDYVVTTDISEMGANFRADRVIDPRRCLKPVILKDGPERVILAGPMPVTVASAAQRRGRIGRNQNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGKAYRHAMEELPDTIETLMLLALIAVLTGGVTLFFLSGRGLGKTSIGLLCVMASSALLWMASVEPHWIAASIILEFFLMVLLIPEPDRQRTPQDNQLAYVVIGLLFMILTVAANEMGLLETTKKDLGIGHVAAESHHHAAMLDVDLHPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIIEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFTPPEKCDTLLCDIGESSPNPTIEEGRTLRVLKMVEPWLRGNQFCIKVLNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPKAKRGTAQIMEVTARWLWGFLSRNKKPRICTREEFTKKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEAQLIRQMESEGIFLPSELETPNLAERVLDWLEKYGIERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEDVPYLGKREDQWCGSLIGLTARATWATNIQVAINQVRRLIGNENYLDYMTSMKRFKNESDPEGALW

SEQ ID NO: 3686 - protein, 3292 aa, Artificial Sequence
  derived and/or modified protein sequence (wt) from DENV-1__KU666942__SS-prME
SVTMLLMLMPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAILRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSTAIGKAWEEGVCGIRSATRLENIMWKQISNELNHILLENGMKFTVVVGDVAGILAQGKKMIRPQPMEHKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRYRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASMELPNSLEELGDGLAMGIMILKLLTDFQSHQLWATLLSLTFIKTTFSLHYAWKTIAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGKGLGKTSIGLLCVMASSALLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPVPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAINMTSRMLLNRFTMAHRKPTYERDVDLGAGTRHVAVEPEVANLDIIGQRIENIKCEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKISGGNMYADDTAGWDTRITEDDLQNEAKITEIMEPEHAQLAKAIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMKDKTHISSWEDVPYLGKREDQWCGSLIGLTARATWATNIQVAINQVRRLIGNENYLDYMTSMKRFKNESDPEGALW

SEQ ID NO: 3687 - protein, 3292 aa, Artificial Sequence
  derived and/or modified protein sequence (wt) from DENV-1__KU666939__SS-prME
SVTMLLMLMPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWVLRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCLPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEHKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLIPLCLSTTSQKTTWLPVLLGSLGCKPLTMFLIAENKIWGRKSWPLNEGIMAVGIVSILLSSLLKNDVPLAGPLIAGGMLIACYVISGSSADLLLEKAAEVSWEEEAEHSGASHNILVEVQDDGTMKIKDEERDDTLTILLKATLLAISGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHATMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLYSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFIDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKAIFKLTYQNKVVRVQRPAKNGTVMDVISRRDQRGSGQVGTYGLNTFTNMEAQLIRQMESEGIFSPSELETPNLAERVLDWLGKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWEDVPYLGKREDQWCGSLIGLTARATWATNIQVAINQVRRLIGNENYLDYMTSMKRFKNESDPEGALW

SEQ ID NO: 3688 - protein, 3292 aa, Artificial Sequence
  derived and/or modified protein sequence (wt) from DENV-1__KU666940__SS-prME
SVTMLLMLTPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEHKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRYRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTIAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGKGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPVPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAINMTSRMLLNRFTMAHRKPTYERDVDLGAGTRHVAVEPEVANLDIIGQRIENIKCEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKISGGNMYADDTAGWDTRITEDDLQNEAKITEIMEPEHAQLAKAIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMKDKTHISSWEDVPYLGKREDQWCGSLIGLTARATWATNIQVAINQVRRLIGNENYLDYMTSMKRFKNESDPEGALW

SEQ ID NO: 3689 - protein, 3292 aa, Artificial Sequence
  derived and/or modified protein sequence (wt) from DENV-1__KU666941__SS-prME
SVTMLLMLMPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIGAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEHKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRYRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTIAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGKGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPVPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAINMTSRMLLNRFTMAHRKPTYERDVDLGAGTRHVAVEPEVANLDIIGQRIENIKCEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKISGGNMYADDTAGWDTRITEDDLQNEAKITEIMEPEHAQLAKAIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMKDKTHISSWEDVPYLGKREDQWCGSLIGLTARATWATNIQVAINQVRRLIGNENYLDYMTSMKRFKNESDPEGALW

SEQ ID NO: 3690 - protein, 3292 aa, Artificial Sequence
  derived and/or modified protein sequence (wt) from DENV-1__KC172835__SS-prME
SVTMLLMLMPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVVNWKGRELKCGSGIFVTNEVHTWTEQYKFQADSPKRLSAAIGKAWEEGVCGIRSATRLENVMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLRLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKTIHEWCCRSCTLPPLRFRGEDGCWYGMEIRPVKEKEENLVKSMVSAGSGEVDSFSLGLLCISIMIEEVMRSRWSRKMLMTGTLAVFFLLIIGQLTWNDLIRLSIMVGANASDKMGMGTTYLALMATFKMRPMFAVGLLFRRLTSREVLLLTIGLSLVASVELPNSLEELGDGLAMGIMILKLLTDFQPHQLWATLLSLTFIKTTFSLHYAWKTMAMVLSIVSLFPLCLSTTSQKTTWLPVLLGSLGCKPLTMFLITENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAALDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVADENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMVHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFIDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMESEHALLAKSIFKLTYQNKVVRVQRPAKNGTVMDVISRRDQRGSGQVGTYGLNTFTNMEAQLIRQMESEGIFSPSELETPNLAERALDWLEKHGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWEDVPYLGKREDQWCGSLIGLTARATWATNIQVAISQVRRLIGNENYLDYMTSMKRFKNESDPEGALW

SEQ ID NO: 3691 - protein, 3292 aa, Artificial Sequence
  derived and/or modified protein sequence (wt) from DENV-1__EU848545__SS-prME
SVTMLLMLLPTALAFHLTTRGGEPHMIVSKQERGKSLLFKTSAGVNMCTIIAMDLGELCEDTMTYKCPRITKAEPDDVDCWCNATDTWVTYGTCSRTGEHRRDKRSVALAPHVGLGLETRAETWMSSEGAWKQIQKVETWALRHPGFTVIALFLAHAIGTSITQKGIIFILLMLVTPSMAMRCVGIGNRDFVEGLSGATWVDVVLEHGSCVTTMAKDKPTLDIELLKTEVTKPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTPQETWNREDLLVTFKTAHAKKQEVVVLGSQEGAMHTALTGATEIQTSGTTKIFAGHLKCRLKMNKLTLKGMSYVMCTGSFKLEKEVAETQHGTVLVQVKYEGTDAPCKIPFSTQDEKGVTQNGRLITANPIVTDKEKPVNIEAEPPFGESYIVVGAGEKALKLSWFKKGSSIGKMLEATARGARRMAILGDTAWDFGSIGGVFTSVGKLVHQIFGTAYGVLFSGVSWTMKIGIGILLTWLGLNSRSASLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVSGILTQGRKMIGPQPMEHKYSWKSWGKAKIIGADVQNTTFIIDGPNTPECPDDQRAWNIWEVEDYGFGIFTTNIWLKLRDSYTQVCDPRLMSAAIKDSKAVHADMGYWIESEKNETWKLARASFIEVKTCVWPKSHTLWSNGVLESEMIIPKIYGGPISQHNYRPGYSTQTAGPWHLGKLELDFDLCEGTTVVVDEHCGNRGPSLRTTTVTGKIIHEWCCRSCTLPPLRFKGEDGCWYGMEIRPVKDKEENLVKSLVSAGSGEVDSFSLGLLCISIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWAALLSLTFIKTTFSLHYAWKTVAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEISWEEEAEHSGASHNILVEVQDDGTMKIKDEERDDTLTILLKATLLAVSGVYPISIPATLFVWYFWQKKKQRSGVLWDTPSPPEVERAVLDDGIYRILQRGLLGRSQVGVGVFQEGVFHTMWHVTRGAVLMYQGKRLEPSWASVKKDLISYGGGWRFQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYIYMGQPLNNDEDHAHWTEAKMLLDNINTPEGIIPALFEPERGKSAAIDGEYRLRGEARKTFVELMRRGDLPVWLSYKVASEGFQYSDRKWCFDGERNNQVLEENMDVEIWTKEGERKKLRPRWLDARTYSDPQALREFKEFAAGRRSVSGDLILEIGKLPQHLTQRAQNALDNLVMLHNSEQGGKAYRHAMEELPDTIETLMLLALIAVLTGGVTLFFLSGRGLGKTSIGLLCVMASSVLLWVASVEPHWIAASIILEFFLMVLLIPEPDRQRTPQDNQLAYVVIGLLFMILTVAANEMGLLETTKKDLGIGHVAVENHHHATMLDVDLRPASAWTLYAVATTIITPMMRHTIENTTANISLTAIANQAAILMGLDKGWPISKMDIGVPLLALGCYSQVNPLTLIAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEVQLIRQMESEGIFSPSELETPNLAERVLDWLEKHGVERLKRMAISGDDCVVKPTDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPIDWVPTSRTTWSIHAHHQWMTTEDMLSVWNRVWIEENPWMEDKTHVSSWEDVPYLGKREDQWCGSLIGLTARATWATNIQVAINQVRRLIGNENYLDYMTSMKRFKNESDLEGALW

SEQ ID NO: 3692 - protein, 3292 aa, Artificial Sequence
  derived and/or modified protein sequence (wt) from DENV-1__KR024708__SS-prME
SVTMLLMLLPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQKVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGVSYVMCTGSFKLEKEVAETQHGTVLVQVKYEGTDAPCKIPISTQDEKGVTQNGRLITANPIVTDKEKPVNIETEPPFGESYIVIGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILTQGKKMIRPQPMEHKYSWKSWGKAKIIGADTQNTTFIIDGPDTPECPDDQRAWNIWEVEDYGFGVFTTNIWLKLRDSYTQMCDHRLMSAAIKDSKAVHADMGYWIESEKNETWKLARASFIEVKTCIWPRSHTLWSNGVLESEMIIPKIYGGPISQHNYRPGYFTQTAGPWHLGKLELDFNLCEGTTVVVDEHCGNRGPSLRTTTVTGKIIHEWCCRSCTLPPLRFRGEDGCWYGMEIRPVKEKEENLVRSMVSAGSGEVDSFSLGLLCVSIMIEEVMRSRWSRKMLMTGTLAVFFLLIMGQLTWNDLIRLCIMVGANVSDRMGMGTTYLALMATFKMRPMFAVGLLFRRLTSREVLLLTIGLSLVASVELPNSLEELGDGLAMGIMMLKLLTDFQSHQLWTTLLSLTFIKTTLSLDYAWKTMAMVLSIVSLFPLCLSTTSQKTTWLPVLLGSFGCKPLTMFLITENKIWGRKSWPLNEGIMAVGIVSILLSSLLKNDVPLAGPLIAGGMLIACYVISGSSADLSLERAAEVSWEEEAEHSGASHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPASIAARGYISTRVGMGEAAAIFMTATPPGSVESFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTAASAAQRRGRIGRNQNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVMASSVLLWMASVEPHWIAASIILEFFLMVLLIPEPDRQRTPQDNQLAYVVIGLLFMILTVAANEMGLLETTKKDLGIGHVVAENHHHATMLDIDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNIVKLHSGRDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEIANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRPKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKSGTVMDVISRRDQRGSGQVGTYGLNTFTNMEVQLIRQMESEGIFSPSELENSNLAERVLDWLEKHGVERLKRMAISGDDCVVKPTDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVNWVPTSRTTWSIHAHHQWMTTEDMLSVWNRVWIEENPWMEDKTHVSSWEDVPYLGKREDQWCGSLIGLTARATWATNIQVAINQVRRLIGNENYLDYMTSMKRFKNESDPEGALW

SEQ ID NO: 3693 - protein, 3292 aa, Artificial Sequence
  derived and/or modified protein sequence (wt) from DENV-1__KR024705__SS-prME
SVTMLLMLLPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQKVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNATTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGVSYVMCTGSFKLEKEVAETQHGTVLVQVKYEGTDAPCKIPISTQDEKGVTQNGRLITANPIVTDKEKPVNIETEPPFGESYIVIGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILTQGKKMIRPQPMEHKYSWKSWGKAKIIGADTQNTTFIIDGPDTPECPDDQRAWNIWEVEDYGFGVFTTNIWLKLRDSYTQMCDHRLMSAAIKDSKAVHADMGYWIESEKNETWKLARASFIEVKTCIWPRSHTLWSNGVLESEMIIPKIYGGPISQHNYRPGYFTQTAGPWHLGKLELDFNLCEGTTVVVDEHCGNRGPSLRTTTVTGKIIHEWCCRSCTLPPLRFRGEDGCWYGMEIRPVKEKEENLVRSMVSAGSGEVDSFSLGLLCVSIMIEEVMRSRWSRKMLMTGTLAVFFLLIMGQLTWNDLIRLCIMVGANVSDRMGMGTTYLALMATFKMRPMFAVGLLFRRLTSREVLLLTIGLSLVASVELPNSLEELGDGLAMGIMMLKLLTDFQSHQLWTTLLSLTFIKTTLSLDYAWKTMAMVLSIVSLFPLCLSTTSQKTTWLPVLLGSFGCKPLTMFLITENKIWGRKSWPLNEGIMAVGIVSILLSSLLKNDVPLAGPLIAGGMLIACYVISGSSADLSLERAAEVSWEEEAEHSGASHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTAASAAQRRGRIGRNQNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVMASSVLLWMASVEPHWIAASIILEFFLMVLLIPEPDRQRTPQDNQLAYVVIGLLFMILTVAANEMGLLETTKKDLGIGHVVAENHHHATMLDIDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNIVKLHSGRDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEIANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRPKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKSGTVMDVISRRDQRGSGQVGTYGLNTFTNMEVQLIRQMESEGIFSPSELENSNLAERVLDWLEKHGVERLKRMAISGDDCVVKPTDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVNWVPTSRTTWSIHAHHQWMTTEDMLSVWNRVWIEENPWMEDKTHVSSWEDVPYLGKREDQWCGSLIGLTARATWATNIQVAINQVRRLIGNENYLDYMTSMKRFKNESDPEGALW

SEQ ID NO: 3694 - protein, 3292 aa, Artificial Sequence
  derived and/or modified protein sequence (wt) from DENV-1__KR024706__SS-prME
SVTMLLMLLPTALAFHLTTRGGEPHMIVSKQERGKSLLFKTSAGVNMCTLIAMDLGELCEDTMTYKCPRITGAEPDDVDCWCNATDTWVTYGTCSQTGEHRRDKRSVALAPHVGLGLETRTETWMSSEGAWRQIQKVETWALRHPGFTVIAFFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTLVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGVSYVMCTGSFKLEKEVAETQHGTVLVQVKYEGTDAPCKIPISTQDEKGVTQNGRLITANPIVTDKEKPVNIETEPPFGESYIVIGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILTQGKKMIRPQPMEHKYSWKSWGKAKIIGADTQNTTFIIDGPDTPECPDDQRAWNIWEVEDYGFGVFTTNIWLKLRDSYTQMCDHRLMSAAIKDSKAVHADMGYWIESEKNETWKLARASFIEVKTCIWPRSHTLWSNGVLESEMIIPKIYGGPISQHNYRPGYFTQTAGPWHLGKLELDFNLCEGTTVVVDEHCGNRGPSLRTTTVTGKIIHEWCCRSCTLPPLRFRGEDGCWYGMEIRPVKEKEENLVRSMVSAGSGEVDSFSLGLLCVSIMIEEVMRSRWSRKMLMTGTLAVFFLLIMGQLTWNDLIRLCIMVGANVSDRMGMGTTYLALMATFKMRPMFAVGLLFRRLTSREVLLLTIGLSLVASVELPNSLEELGDGLAMGIMMLKLLTDFQSHQLWTTLLSLTFIKTTLSLDYAWKTMAMVLSIVSLFPLCLSTTSQKTTWLPVLLGSFGCKPLTMFLITENKIWGRKSWPLNEGIMAVGIVSILLSSLLKNDVPLAGPLIAGGMLIACYVISGSSADLSLERAAEVSWEEEAEHSGASHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTAASAAQRRGRIGRNQNKEGDQYIYMGQPLNNDEDHAHWTEAKMLLDNINTPEGIIPALFEPEREKSAAIDGEYRLGGEARKTFVELMKRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVMASSVLLWMASVEPHWIAASIILEFFLMVLLIPEPDRQRTPQDNQLAYVVIGLLFMILTVAANEMGLLETTKKDLGIGHVVAENHHHATMLDIDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNIVKLHSGRDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEIANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRPKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKSGTVMDVISRRDQRGSGQVGTYGLNTFTNMEVQLIRQMESEGIFSPSELENSNLAERVLDWLEKHGVERLKRMAISGDDCVVKPTDDRFATALTALNDMGKVRKDIPQWEPSKGWNDWQLVPFCSHHFHQLIMKDGREIVVPCRNQDELVGRARVSQGAGWSLRETACLGKSYAQMWQLMYFHRRDLRLAANAICSAVPVNWVPTSRTTWSIHAHHQWMTTEDMLSVWNRVWIEENPWMEDKTHVSSWEDVPYLGKREDQWCGSLIGLTARATWATNIQVAINQVRRLIGNENYLDYMTSMKRFKNESDPEGALW

SEQ ID NO: 3695 - protein, 3292 aa, Artificial Sequence
  derived and/or modified protein sequence (wt) from DENV-1__KR024707__SS-prME
SVTMLLMLLPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWRQIQKVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGVSYVMCTGSFKLEKEVAETQHGTVLVQVKYEGTDAPCKIPISTQDEKGVTQNGRLITANPIVTDKEKPVNIETEPPFGESYIVIGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILTQGKKMIRPQPMEHKYSWKSWGKAKIIGADTQNTTFIIDGPDTPECPDDQRAWNIWEVEDYGFGVFTTNIWLKLRDSYTQMCDHRLMSAAIKDSKAVHADMGYWIESEKNETWKLARASFIEVKTCIWPRSHTLWSNGVLESEMIIPKIYGGPISQHNYRPGYFTQTAGPWHLGKLELDFNLCEGTTVVVDEHCGNRGPSLRTTTVTGKIIHEWCCRSCTLPPLRFRGEDGCWYGMEIRPVKEKEENLVRSMVSAGSGEVDSFSLGLLCVSIMIEEVMRSRWSRKMLMTGTLAVFFLLIMGQLTWNDLIRLCIMVGANVSDRMGMGTTYLALMATFKMRPMFAVGLLFRRLTSREVLLLTIGLSLVASVELPNSLEELGDGLAMGIMMLKLLTDFQSHQLWTTLLSLTFIKTTLSLDYAWKTMAMVLSIVSLFPLCLSTTSQKTTWLPVLLGSFGCKPLTMFLITENKIWGRKSWPLNEGIMAVGIVSILLSSLLKNDVPLAGPLIAGGMLIACYVISGSSADLSLERAAEVSWEEEAEHSGASHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTAASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLTLIAVLTGGVTLFFLSGKGLGKTSIGLLCVMASSVLLWMASVEPHWIAASIILEFFLMVLLIPEPDRQRTPQDNQLAYVVIGLLFMILTVAANEMGLLETTKKDLGIGHVVAENHHHATMLDIDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNIVKLHSGRDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEIANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRPKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKSGTVMDVISRRDQRGSGQVGTYGLNTFTNMEVQLIRQMESEGIFSPSELENSNLAERVLDWLEKHGVERLKRMAISGDDCVVKPTDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVNWVPTSRTTWSIHAHHQWMTTEDMLSVWNRVWIEENPWMEDKTHVSSWEDVPYLGKREDQWCGSLIGLTARATWATNIQVAINQVRRLIGNENYLDYMTSMKRFKNESDPEGALW

SEQ ID NO: 3696 - protein, 3292 aa, Artificial Sequence
  derived and/or modified protein sequence (wt) from DENV-1__KC172829__SS-prME
SVTMLLMLMPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGTFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVVNWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLRLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIIGQLTWNDLIRLSIMVGANASDKMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLITENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTTEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFSGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVADENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMVHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMESEHALLAKSIFKLTYQNKVVRVQRPAKNGTVMDVISRRDQRGSGQVGTYGLNTFTNMEAQLIRQMESEGIFSPSELETPNLAERALDWLEKHGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWEDVPYLGKREDQWCGSLIGLTARATWATNIQVAISQVRRLIGNENYLDYMTSMKRFKNESDPEGALW

SEQ ID NO: 3697 - protein, 3292 aa, Artificial Sequence
  derived and/or modified protein sequence (wt) from DENV-1__EU359008__SS-prME
SVTMLLMLMPTALAFHLTTRGGEPHMIVSKQERGKSLLFKTSAGVNMCTLIAMDLGELCEDTLTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTTQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFLTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGALLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEHKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQVTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAAIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKAIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWEDVPYLGKREDQWCGSLIGLTARATWATNIQVAINQVRRLIGNENYLDYMTSMKRFKNESDPEGALW

SEQ ID NO: 3698 - protein, 3292 aa, Artificial Sequence
  derived and/or modified protein sequence (wt) from DENV-1__AY835999__SS-prME
SVTMLLMLMPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFLTQDEKGVTQNGRLITANPIVTDKEKPVNIEAEPPFGESYIVIGAGEKALKLSWFKKGSSIGKMFEATARGARRMAILGDTAWDFGSVGGVFTSVGKLVHQIFGTAYGVLFSGVSWTMKLGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILVQGKKMIRPQPMEYKYSWKSWGKAKIIGADVQNSTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGENGCWYGMEIRPVKEKEENLVKSMVSAGSGEVDSFSLGLLCISIMIEEVMRSRWSRKMLMTGILAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQTKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSMEAFPQSNAVIQDEERDIPERSWNSGYEWITDFPGKTVWFVPSIKAGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGKGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAALLMLVAHYAIIGPGLQAKATREAQKRTAAGIMKNPTIDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDDRFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHAQLAKSIFKLTYQNKVVRVQRPAKNGTVMDVISRRDQRGSGQVGTYGLNTFTNMEAQLIRQMESEGIFSPNELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTRISSWEDVPYLGKREDQWCGSLIGLTARATWATNIQVAINQVRRLIGNENYSDYMTSMKRFKNESEPEGALW

SEQ ID NO: 3699 - protein, 3292 aa, Artificial Sequence
  derived and/or modified protein sequence (wt) from DENV-1__KP686070__SS-prME
SVTMLLMLLPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWRQIQKVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGVSYVMCTGSFKLEKEVAETQHGTVLVQVKYEGTDAPCKIPISTQDEKGVTQNGRLITANPIVTDKEKPVNIETEPPFGESYIVIGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILTQGKKMIRPQPMEHKYSWKSWGKAKIIGADTQNTTFIIDGPDTPECPDDQRAWNIWEVEDYGFGVFTTNIWLKLRDSYTQMCDHRLMSAAIKDSKAVHADMGYWIESEKNETWKLARASFIEVKTCIWPRSHTLWSNGVLESEMIIPKIYGGPISQHNYRPGYFTQTAGPWHLGKLELDFNLCEGTTVVVDEHCGNRGPSLRTTTVTGKIIHEWCCRSCTLPPLRFRGEDGCWYGMEIRPVKEKEENLVRSMVSAGSGEVDSFSLGLLCVSIMIEEVMRSRWSRKMLMTGTLAVFFLLIMGQLTWNDLIRLCIMVGANVSDRMGMGTTYLALMATFKMRPMFAVGLLFRRLTSREVLLLTIGLSLVASVELPNSLEELGDGLAMGIMMLKLLTDFQSHQLWTTLLSLTFIKTTLSLDYAWKTMAMVLSIVSLFPLCLSTTSQKTTWLPVLLGSFGCKPLTMFLITENKIWGRKSWPLNEGIMAVGIVSILLSSLLKNDVPLAGPLIAGGMLIACYVISGSSADLSLERAAEVSWEEEAEHSGASHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTAASAAQRRGRIGRNQNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVMASSVLLWMASVEPHWIAASIILEFFLMVLLIPEPDRQRTPQDNQLAYVVIGLLFMILTVAANEMGLLETTKKDLGIGHVVAENHHHATMLDIDLHPASAWTLYAVATTIITPMMRHTIENTTANISLTAIANQAAILMGLDKGWPISKMDIGVPLLALGCYSQVNPLTLTAAVSMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNIVKLHSGRDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEIANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRPKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKSGTVMDVISRRDQRGSGQVGTYGLNTFTNMEVQLIRQMESEGIFSPSELENSNLAERVLDWLEKHGVERLKRMAISGDDCVVKPTDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVNWVPTSRTTWSIHAHHQWMTTEDMLSVWNRVWIEENPWMEDKTHVSSWEDVPYLGKREDQWCGSLIGLTARATWATNIQVAINQVRRLIGNENYLDYMTSMKRFKNESDPEGALW

SEQ ID NO: 3700 - protein, 3292 aa, Artificial Sequence
  derived and/or modified protein sequence (wt) from DENV-1__KF672760__SS-prME
SVTMLLMLLPTALAFHLTTRGGEPHMIVSKQERGKSLLFKTSAGVNMCTLIAMDLGELCEDTMTYKCPRITEAEPDDVDCWCNATDTWVTYGTCSQTGEHRREKRSVALAPHVGLGLETRTETWMSSEGAWKQIQRVETWALRHPGFTVIAFFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKRGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNTTFIIDGPDTPECPDGQRAWNIWEVEDYGFGVFTTNIWLKLRDSYTQMCDHRLMSAAIKDSKAVHADMGYWIESEKNETWKLARASFIEVKTCTWPKSHTLWSNGVLESEMIIPKIFGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCVSMMIEEVMRSRWSRKMLMTGTLAVFLLLIMGQLTWNDLIRLCIMVGANASDRMGMGTTYLALMATFKMRPMFAVGLLFRRLTSREVLLLTIGLSLVACVELPNSLEELGDGLAMGIMMLKLLTEFQPHQLWTTLLSLTFVKTTLSLDYAWKTTAMVLSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEQEAEHSGASHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGYVAAENHQHATMLDVDLHPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLRGNQFCIKILNPYMPSVVETLERMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEVQLIRQMESEGIFLPSELETPNLAERALDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPASRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 3701 - protein, 3292 aa, Artificial Sequence
  derived and/or modified protein sequence (wt) from DENV-1__KF672759__SS-prME
SVTMLLMLLPTALAFHLTTRGGEPHMIVSKQERGKSLLFKTSVGVNMCTLIAMDLGELCEDTMTYKCPRITEAEPDDVDCWCNATDTWVTYGTCSQTGEHRRDKRSVALAPHVGLGLETRTETWMSSEGAWKQIQKVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQVKYEGTDAPCKIPFLTQDEKGVTQNGRLITANPIVTDKEKPVNIETEPPFGESYIVVGAGEKALKLSWFKKGSSIGKMFEATARGARRMAILGDTAWDFGSIGGLFTSVGKLIHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNYILLENDMKFTVVVGDVNGILAQGKKMIRPQPMEHKYSWKSWGKAKIIGADIQNTTFIIDGPDTPECPDDQRAWNIWEVEDYGFGIFTTNIWLKLRDSHTQMCDHRLMSAAIKDSKAVHADMGYWIESEKNETWKLARASFIEVKTCIWPKSHTLWSNGVLESEMVIPKIYGGPISQHNYRPGYFTQTAGPWHLGKLELDFDLCEGTTVVVDEHCGYRGPSLRTTTVTGKIIHEWCCRSCTLPPLRFRGEDGCWYGMEIRPVKEKEENLVRSMVSAGSGEVDSFSLGILCVSILIEEVMRSRWSRKMLMTGTLAVFLLLIMGQLTWNDLIRLCIMVGANASDRMGMGTTYLALMATFKMRPMFAVGLLFRRLTCREVLLLTVGLSLVASVELPNSLEELGDGLAMGIMMLKLLTDFQPHQLWTTLLSLTFIRTSLSLDYAWKTMAMALSIVSLFPLCLSTTSQKTTWLPVLLGSFGCKPLTMFLITENKIWGRKSWPINEGIMAVGIVSILLSSLLKNDVPLAGPLIAGGMLIACYVISGSSADLSLEKAAEVSWEEEAEHSGTSHNILVEVQDDGTMKIKDEERDDTLTILLKATLLAVSGVYPMSIPATLFVWYFWQKKKQRSGVLWDTPSPPKVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKATQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKEGPERVILAGPMPVTVASAAQRRGRIGRNQNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVMASSALLWMASVEPHWIAASIILEFFLMVLLIPEPDRQRTPQDNQLAYVVIGLLFMILTVAANEMGLLETTKKDLGIGHVAVENHHHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVTIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKKSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKSGTVMDVISRRDQRGSGQVGTYGLNTFTNMEVQLIRQMESEGIFSPSELETPNLAKKVLDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 3702 - protein, 3292 aa, Artificial Sequence
  derived and/or modified protein sequence (wt) from DENV-1__KF672761__SS-prME
SVTMLFMLLPTALAFHLTTRGGEPHMIVSKQERGKSLLFKTSAGVNMCTLIAMDLGELCEDTMTYKCPRITEAEPDDVDCWCNATDTWVTYGTCSQTGGHRRDKRSVALAPHVGLGLETRTETWMSSEGAWKQIQKVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGTSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNTTFIIDGPDTPECPDEQRAWNIWEVEDYGFGIFTTNIWLKLRDSYTQMCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCVSIMIEEVMRSRWSRKMLMTGTLAVFLLLIMGQLTWNDLIRLCIMVGANASDKMGMGTTYLALMATFKMRPMFAVGLLFRRLTSREVLLLTIGLSLVASVELPNSLEELGDGLAMGIMMLKLLTEFQPHQLWTTLLSLTFIKTTLSLDYAWKTTAMVLSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEEEAEHSGTSHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGHVAAENHQHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEVQLIRQMESEGIFLPSELETPNLAERVLDWLEKHGAERLKRMAISGDDCVVKPIDDRFATALIALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 3703 - protein, 3292 aa, Artificial Sequence
  derived and/or modified protein sequence (wt) from DENV-1__KF672762__SS-prME
SVTMLLMLLPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQKVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGTSYVMCTGSFKLEKEVAETQHGTVLVQVKYEGIDAPCKIPFSTQDEKGVTQNGRLITANPIVTDKEKPVNIETEPPFGESYIVVGAGEKALKLSWFKKGSSIGKMFEATARGARRMAILGDTAWDFGSIGGVFTSVGKLVHQVLGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNTTFIIDGPDTPECPDEQRAWNIWEVEDYGFGIFTTNIWLKLRDSYTQMCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCVSIMIEEVMRSRWSRKMLMTGTLAVFLLLIMGQLTWNDLIRLCIMVGANASDKMGMGTTYLALMATFKMRPMFAVGLLFRRLTSREVLLLTIGLSLVASVELPNSLEELGDGLAMGIMMLKLLTEFQPHQLWTTLLSLTFIKTTLSLDYAWKTTAMVLSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEEEAEHSGTSHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGRTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGHVAAENHQHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEVQLIRQMESEGIFLPSELETPNLAERVLDWLEKHGAERLKRMAISGDDCVVKPIDDRFATALIALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPIDWVPTSRTTWSIHAHHQWMTTEDMLSVWNRVWIEENPWMEDKAHVSSWEEVPYLGKREDQWCGSLIGLTARATWATNIQVAINQVRRLIGNENYLDYMTSMKRFKNESDPEGALW

SEQ ID NO: 3704 - protein, 3292 aa, Artificial Sequence
  derived and/or modified protein sequence (wt) from DENV-1__JF459993__SS-prME
SVTMLFMLLPTSLAFHLTTRGGEPHMIVSKQERGKSLLFKTSAGVNMCTLIAMDLGELCEDTMTYKCPRITETEPDDVDCWCNATETWVTYGTCSQTGEHRRDKRSVALAPHVGLGLETRTETWMSSEGAWKQIQKVETWALGHPGFTVIALFLAHAIGTSITQKGIIFILLMLVTPSMAMRCVGIGNRDFVEGLSGATWVDVVLEHGSCVTTMAKDKPTLDIELLKTEVTNPAILRKLCIEAKISNTTTDSRCPTQGEATLVEEQDTNFVCRRTFVDRGWGNGCGLFGKGSLITCAKFKCVTKLEGKIVQYENLKYSVIVTVHTGDQHQVGNETTEHGTTATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGVSYVMCTGSFKLEKEVAETQHGTVLVQVKYEGTDAPCKIPFSSQDEKGVIQNGRLITANPIVTDKEKPVNIEAEPPFGESYIVVGAGEKALKLSWFKKGSSIGKMFEATARGARRMAILGDTAWDFGSIGGVFTSVGKLVHQIFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNATFIIDGPNTPECPDDQRAWNIWEVEDYGFGIFTTNIWLKLRDSYTQVCDHRLMSAAIKDSKAVHADMGYWIESEKNETWKLARASFIEVKTCVWPKSHTLWSNGVLESEMIIPKIYGGPISQHNHRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHALEELPDTIETLMLLALIAVLTGGVTLFFLSGRGLGKTSIGLLCVMASSALLWMASVEPHWIAASIILEFFLMVLLIPEPDRQRTPQDNQLAYVVIGLLFMILTVAANEMGLLETTKKDLGIGHVAVENHHHASMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKSIFKLTYQNKVVRVQRPAKNGTVMDVISRRDQRGSGQVGTYGLNTFTNMEAQLIRQMESEEIFSPSELETPNLAERVLDWLEKYGVERLKRMAISGDDCVVKPIDDRFATALTALNDMGKVRKDIPQWEPSKGWNDWQQVPFCSHHFHQLIMKDGREVVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEDVPYLGKREDQWCGSLIGLTARATWATNIQVAINQVRRLIGNENYLDYMTSMKRFKNESDPEGALW

SEQ ID NO: 3705 - protein, 3292 aa, Artificial Sequence
  derived and/or modified protein sequence (wt) from DENV-1__KF672763__SS-prME
SVTMLLMLLPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQKVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGTSYVMCTGSFKLEKEVAETQHGTVLVQVKYEGTDAPCKIPFSTQDEKGVTQNGRLITANPIVTDKEKPVNIETEPPFGESYIVVGVGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGRAWEEGVCGIRSATRLENIMWKQISNELNHILLENDIKFTVVVGNADGILAQGKKMIRPQPMEHKYSWKSWGKAKIIGADIQNTTFIIDGPDTPECPDEQRAWNIWEVEDYGFGIFTTNIWLKLRDSYTQMCDHRLMSAAIKDSKAVHADMGYWIESEKNETWKLARASFIEVKTCIWPKSHTLWSNGVLESEMIIPKMYGGPISQHNYRPGYFTQTAGPWHLGKLELDFDLCEGTTVVVDEHCGSRGPSLRTTTVTGKIIHEWCCRSCTLPPLRFRGEDGCWYGMEIRPVKEKEENLVRSMVSAGSGEVDSFSLGILCVSIMIEEVMRSRWSRKMLMTGTLAVFLLLIMGQLTWNDLIRLCIMVGANASDKMGMGTTYLALMATFKMRPMFAVGLLFRRLTSREVLLLTIGLSLMASVELPNSLEELGDGLAMGIMMLKLLTEFQPHQLWTTLLSLTFIKTTLSLDYAWKTTAMVLSIVSLFPLCLSTTSQKTTWLPVLLGSFGCKPLTMFLITENEIWGRKSWPLNEGIMAIGIVSILLSSLLKNDVPLAGPLIAGGMLIACYVISGSSADLSLEKAAEVSWEEEAEHSGTSHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGHVAAENHQHATMLDVDLHPASAWTLYAVATTVITPMMRHTIENTTANISLTAIANQAAILMGLDKGWPISKMDLGVPLLALGCYSQVNPLTLTAAVLMLVAHYAIIGPGLQAKATREAQKRTAAGIMKNPTIDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLRNEAKITDIMEPEHALLATSIFKLTYQNKVVRVQRPAKNGTVMDVISRRDQRGSGQVGTYGLNTFTNMEVQLIRQMESEGIFFPSELESPNLAERVLDWLEKHGAERLKRMAISGDDCVVKPIDDRFATALIALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 3706 - protein, 3292 aa, Artificial Sequence
  derived and/or modified protein sequence (wt) from DENV-1__KF672764__SS-prME
SVTMLLMLLPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQKVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGTSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGRAWEEGVCGIRSATRLENIMWKQISNELNHILLENDIKFTVVVGNANGILTQGKKMIRPQPMEHKYSWKSWGKAKIIGADIQNTTFIIDGPDTPECPDEQRAWNIWEVEDYGFGIFTTNIWLKLRDSYTQMCDHRLMSAAIKDSKAVHADMGYWIESEKNETWKLARASFIEVKTCIWPKSHTLWSNGVLESEMIIPKMYGGPISQHNYRPGYFTQTAGPWHLGKLELDFDLCEGTTVVVDEHCGSRGPSLRTTTVTGKIIHEWCCRSCTLPPLRFRGEDGCWYGMEIRPVKEKEENLVKSMVSAGSGEVDSFSLGILCVSIMIEEVMRSRWSRKMLMTGTLAVFLLLIMGQLTWNDLIRLCIMVGANASDKMGMGTTYLALMATFKMRPMFAVGLLFRRLTSREVLLLTIGLSLVASVELPNSLEELGDGLAMGIMMLKLLTEFQPHQLWTTLLSLTFIKTTLSLDYAWKTTAMVLSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEEEAEHSGTSHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGHVAAENHQHATMLDVDLHPASAWTLYAVATTVITPMMRHTIENTTANISLTAIANQAAILMGLDKGWPISKMDLGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRTEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEVQLIRQMESEGIFFPSELESPNLAERVLDWLEKHGAERLKRMAISGDDCVVKPIDDRFATALIALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 3707 - protein, 3292 aa, Artificial Sequence
  derived and/or modified protein sequence (wt) from DENV-1__EU863650__SS-prME
SVTMLLMLLPTVLTFHLTTRGGEPHMIVSKQERGKSLLFKTSAGVNMCTLIAMDLGELCDDTMTYKCPRITETEPDDVDCWCNATETWVTYGTCSQTGEHRRDKRSVALAPHVGLGLETRTETWMSSEGAWRQIQKVETWALRHPGFTVIALFLAHAIGTSITQKGIIFILLMLVTPSMAMRCVGIGNRDFVEGLSGATWVDVVLEHGSCVTTMAKDKPTLDIELLKTEVTNPAVLRKLCIEAKISNTTTDSRCPTQGEATLVEEQDTNFVCRRTFVDRGWGNGCGLFGKGSLITCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGISYVMCTGLFKLEKEVAETQHGTVLVQVKYEGTDAPCKIPFSSQDEKGATQNGRLVTANPIVTDKEKPVNIEAEPPFGESYIVVGAGEKALKLSWFKKGSSIGKMFEATARGARRMAILGDTAWDFGSIGGVFTSVGKLVHQIFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVSGILAQGKKTIRPQPMEHKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCVWPKSHTLWSHGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLVVFLLLTLGQLTWNDLIRLCIMVGANASDNMGMGTTYLALMATFRMRPMFAVGLLFRRLTSREVLLLTVGLSLVASVELPNSLDELGDGLAMGIMILKLLTDFQSHQLWATLLSLTFVKTTLSLHYAWKTMAMILSIVSLLPLCLSTTSQKTTWLPVLLGSLGCKPLTMFLITENKIWGRKSWPLNEGIMAVGIVSILLSSLLKNDVPLAGPLIAGGMLIACYVISGSSADLSLEKAAKVSWEEEAEHSGASHNILVEIQDDGTMKIKDEERDDTITILLKATLLAISGVYPMSIPATLFVWHFWQKKKQRSGVLWDTPSPPEVEKAVLDDGIYRILQRGLLGRSQVGVGVFQEGVFHTMWHVTRGAVLMYQGKRLEPSWASVKKDLISYGGGWRFQGSWNTGEEVQVIAVEPGKNPKNVQTAPGTFKTSEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLVLAPTRVVASEMAEALKGMPIRYQTTAVKSEHTGKEIVDLMCHATFTMRLLSPVRVPNYNMIIMDEAHFTDPASIAARGYISTRVGMGEAAAIFMTATPPGSVEAFPQSNAVIQDEEKDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQKALDNLVMLHNSEQGGKAYRHAMEELPDTIETIMLLALIAVLTGGVTLFFLSGRGLGKTSIGLLCVTSSSALLWMASVEPHWIAASIILEFFLMVLLIPEPDRQRTPQDNQLAYVVIGLLFMILTVAATEMGLLETTKKDLGIGHAAAENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFKTYKRSGIIEVDRSEAKEGLKRGETTKHAVSRGTAKLRWFVERNLVKPEGKVIDLGCGRGGWSYYCAGLKKVTEVKGSTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSPKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEAQLIRQMESEGIFLPSELEPPNLAGRVPDWLEKHGTERLRRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEDVPYLGKREDQWCGSLIGLTARATWATNIQVAINQVRRLIGNENYLDYMTSMKRFKNESDPEGALW

SEQ ID NO: 3708 - protein, 3292 aa, Artificial Sequence
  derived and/or modified protein sequence (wt) from DENV-1__KU365900__SS-prME
SVTMLLMLMPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEHKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGPGEVDSFSLGLLCISIMIEEVMRSRWSRKMLMTGTLAVFFLLIMGQLTWNDLIRLCIMVGANASDRMGMGTTYLALMATFKMRPMFAVGLLLRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRKWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHATMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLYSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYEKDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFIDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKISGGNMYADDTAGWDTRITEDDLQNEAKITDIMEPEHALLAKAIFKLTYQNKVVRVQRPAKNGTVMDVISRRDQRGSGQVGTYGLNTFTNMEAQLIRQMESEGIFSPSELETPNLAERVLDWLGKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWEDVPYLGKREDQWCGSLIGLTARATWATNIQVAINQVRRLIGNENYLDYMTSMKRFKNESDPEGALW

SEQ ID NO: 3709 - protein, 3292 aa, Artificial Sequence
  derived and/or modified protein sequence (wt) from DENV-1__FJ176779__SS-prME
SVTMLLMLMPTALAFHLTTRGGEPHMIVSKQERGKSLLFKTSAGVNMCTLVAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGVGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEHKYSWKNWGKAKIIGADVQNSTFIIDGPNTPECSDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSMTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPKVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKMRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITEFPGKTVWFVPSIKAGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGKGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTIDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVTNLDIIGQRIENIKYEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWSFLSRNKKPRICTREEFTRKVRSNAAIGAVFVDENQWNSAKEAVEDDRFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKSIFKLTYQNKVVRVQRPAKNGTVMDVISRRDQRGSGQVGTYGLNTFTNMEAQLIRQMESEGIFSPNELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTRISSWEDVPYLGKREDQWCGSLIGLTARATWATNIQVAINQVRRLIGNENYSDYMTSMKRFKNESEPEGALW

SEQ ID NO: 3710 - protein, 3292 aa, Artificial Sequence
  derived and/or modified protein sequence (wt) from DENV-1__FJ176780__SS-prME
SVTMLLMLMPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPTSLEELGDGLAMGIMILKLLTDFQSHQLWATLLSLTFVKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGYQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVTNLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAIYQVRRLIGNENYLDYMTSMKRFKNESDPEGALW

SEQ ID NO: 3711 - protein, 3292 aa, Artificial Sequence
  derived and/or modified protein sequence (wt) from DENV-1__JN205310__SS-prME
SVTVLFMLLPTALAFHLTTLGGEPHMIVSKQERGKSLLFKTSAGVNMCTLIAMDLGELCEDTMTYKCPRITETEPDDVDCWCNATETWVTYGTCSQTGEHRRDKRSVALAPHVGLGLETRTETWMSSEGAWKQIQKVETWALRHPGFTVIALFLAHAIGTSITQKGIIFILLMLVTPSMAMRCVGIGNRDFVEGPSGATWVDVVLEHGSCVTTMAKNKPTLDIELLKTEVTNPAILRKLCIEAKISNTTTDSRCPTQGEATLVEEQDTNFVCRRTFVDRGWGNGCGLFGKGSLITCAKFKCVTKLEGKIVQYENLKYSVIVTVHTGDQHQVGNETTEHGTTAIITPQAPTSEIQLTDYGALTPDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGVSYVMCTGSFKLEKEVAETQHGTVLVQVKYEGTDAPCKIPSSSQDEKGVIQNGRLITANPIVTDKEKPVNIEAEPPFGESYIVVGAGEKALKLSWFKKGSSIGKMFEATARGARRMAILGDTAWDFGSIGGVFTSVGKLVHQIFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVSGILAQGKKMIRPQPMEHKYSWKSWGKAKIIGADVQNTTFIIDGPNTPECPDNQRAWNIWEVEDYGFGIFTTNIWLKLRDSFTQVCDHRLMSAAIKDSKAVHADMGYWIESEKKETWKLARASFIEVKTCIWPKSHTLWSNGVLESEMIIPKIYGGPVSQHNYRPGYFTQTAGPWHLGKLELDFDLCEGTTVVVDENCGNRGPSLRTTTVTGKTTHERCCRSCTLPPLRFKREDGCWYGMEIRPVKEKEENLVKSMVSAGSGEVDSFSLGLLCISIMIEEVMRSRWSRKMLMTGTLAVFLLLTMGQSTWNDLIRLCTMVGANASDMMGMGTTYLALMATFRMRPMFAVGLLFRRLTSREILLLTVGLSLVASVELPNSLEELGDGLAMGIMMLKLLTDFQPHQLWATLLSLTFVKTTLSLHYAWKTMAMILSIVSLLPLCLSTTSQKTTWLPVLLGSLGCKPLTMFLITENKIWGRRSWPLNEGIMAIGIVSILLSSPLKNDVPLAGPLIAGGMLIACYVISGSSADLSLEKAAEVSWEDEAEHSGASHNILVEVQDDGTMKIKDEERDDTLTILLKATLLVISGVYPMSIPATLFVWYFWQKKKQRSGVLWDTPSPPEVERAVLDNGIYRILQRGLLGRSQVGVGVFQEGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSTIVNREGKIVGLYGNGVVTTSGTYVSAIAQAKASQEGPLPEIEDEVFRKRNLTIMDLHPGSGKTRRYLPAIVREAIKRKLRTLVLAPTRVVASEMAEALKGMPIRYQTTAVKSEHTGKEIVDLMCHATFTMRLLSPVRVPNYNMIIMDEAHFTDPASIAARGYISTRVGMGEAAAIFMTATPPGSVEAFPQSNAVIQDEERDIPERSWNSGYEWITDFPGKTVWFVPSIKSGNDIANCLRKNGKRVVQLSRKTFDTEYQKTKNNDWDYVVTTDISEMGANFRADRVIDPRRCLKPVILKDGPERVILAGPMPVTVASAAQRRGRIGRNPNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLKAQNALDNLVMLHNSEQGGKAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHAAAENHHHAAMLDVDLHPASAWTLYAVATTIITPMMRHTIENTTANISLTAIANHAAILMGLDKGWPISKMDIGVPLLALGCYSQVNPLTLTAAVLMLVAHYAIIGPGLQAKATREAQKRTAAGIMKNPTVDGIVAIDLDPVVYDAKIEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNIYKRSGIIEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDERFWDLVHRERELHKQGKCATCVYNMMGRREKKLGEFGKAKGSRAIWYMWLGARFLEFEALGFMNEDHWFSRENSLSGVEGEGHHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEAQLIRQMESEGIFSPSELETPNLAERVFDWLEKHGIERLKRMAISGDDCVVKPIDDRFATALTALNDMGKVRKDIPQWEPPKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEDVPYLGKREDQWCGSLIGLTARATWATNIQVAINQVRRLIGNENYLDYMTSMKRFKNESDPEGALW

SEQ ID NO: 3712 - protein, 3292 aa, Artificial Sequence
  derived and/or modified protein sequence (wt) from DENV-1__HQ332182__SS-prME
SVTMLLMLLPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGTSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNTTFIIDGPDTPECPDDQRAWNIWEVEDYGFGIFTTNIWLKLRDSYTQMCDHRLMSAAIKDSKAVHADMGYWIESEKNETWKLARASFIEVKTCTWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCVSIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMMLKLLTEFQPHQLWTTLLSLTFIKTTLSLDYAWKTTAMALSIVSLFPLCLSTTSQKTTWLPVLLGSFGCKPLTMFLITENKIWGRKSWPINEGIMAIGIVSILLSSLLKNDVPLAGPLIAGGMLIACYVISGSSADLSLEKAAEVSWEQEAEHSGTSHNILVEVQDDGTMRIKDEEKDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSVLLWMASVEPHWIAASIILEFFLMVLLIPEPDRQRTPQDNQLAYVVIGLLFMILTVAANEMGLLETTKRDLGIGHVAAENHQHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCASQVLLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAVGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEVQLIRQMESEGIFLPSELETPNLAERVLDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 3713 - protein, 3292 aa, Artificial Sequence
  derived and/or modified protein sequence (wt) from DENV-1__HQ332181__SS-prME
SVTMLLMLLPTALAFHLTTRGGEPHMIVSKQERGKSLLFKTSAGVNMCTLIAMDLGELCEDTMTYKCPRITEAEPDDVDCWCNATDTWVTYGTCSQTGEHRREKRSVALAPHVGLGLETRTETWMSSEGAWKQIQRVETWALRHPGFTVIAFFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKRGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILVQGKKMIRPQPMEHKYSWKSWGKAKIIGADIQNTTFIIDGPDTPECPDGQRAWNIWEVEDYGFGVFTTNIWLKLRDSYTQMCDHRLMSAAIKDSKAVHADMGYWIESEKNETWKLARASFIEVKTCTWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGTGEVDSFSLGILCVSIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMMLKLLTEFQPHQLWTTLLSLTFVKTALSLDYAWKTTAMVLSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEQEAEHSGASHNILVEVQDDGTMKIKDEERDDTLTILLKATLLAVSGVYPMSIPATLFVWYFWQKKKQRSGVLWDTPSPPEVERAVLDNGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGYVAAENHQHATMLDVDLHPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEVQLIRQMESEGIFLPSELETPNLAERALDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDSEGALW

SEQ ID NO: 3714 - protein, 3292 aa, Artificial Sequence
  derived and/or modified protein sequence (wt) from DENV-1__HQ332180__SS-prME
SVTMLLMLLPTALAFHLTTRGGEPHMIISKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGAMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNTTFIIDGPDTPECPDGQRAWNIWEVEDYGFGIFTTNIWLKLRDSYTQMCDHRLMSAAIKDSKAVHADMGYWIESEKNETWKLARASFIEVKTCTWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCVSIMIEEVMRSRWSRKMLMTGTLAVFLLLIMGQLTWNDLIRLCIMVGANASDRMGMGTTHLALMATFKMRPMFAVGLLFRRLTSREVLLLTIGLSLMASMELPNSLEELGDGLAMGIMMLKLLTEFQPHQLWTTLLSLTFVKTTLSLDYAWKTTAMILSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEQEAEHSGASHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGYVAAENHQHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLKGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEVQLIRQMESEGIFLPSELETPNLAERVLDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 3715 - protein, 3292 aa, Artificial Sequence
  derived and/or modified protein sequence (wt) from DENV-1__HQ332179__SS-prME
SVTMLLMLLPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNTTFIIDGPDTPECPDGQRAWNIWEVEDYGFGIFTTNIWLKLRDSYTQMCDHRLMSAAIKDSKAVHADMGYWIESEKNETWKLARASFIEVKTCTWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCASIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMMLKLLTEFQPHQLWTTLLSLTFVKTTLSLDYAWKTTAMVLSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLLLEKAAEVSWEQEAEHSGASHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMACVEPHWIAASIILEFFLMVLLIPEPDRQRTPQDNQLAYVVIGLLFMILTVAANEMGLLETTKKDLGIGYVAAENHQHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLKGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEVQLIRQMESEGIFLPSELETPNLAERVLDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 3716 - protein, 3292 aa, Artificial Sequence
  derived and/or modified protein sequence (wt) from DENV-1__KR919820__SS-prME
TVVALLMLLPMVFSFHLTTRGGEPHMIVNKQERGKSLLFKTSGGINMCTLIAMDLGDLCEDTMTYKCPRITEAEPDDVDCWCNATDTWVTYGICSPTGEHRREKRSVALAPHVGLGLETRAETWMSSEGAWKQIQRVETWALRHPGFTVIALFLAHIIGTSITQKGVIFILLMLVTPSMAMRCVGVGNRDFVEGLSGATWVDVVLEHGSCVTTMAKNKPTLDIELLKTEVSNPAVLRKLCIEARISNTTTDSRCPTQGEASLSEEQDTNFVCRRTLVDRGWGNGCGLFGKGSLITCAKFECLTKMEGKIVQYENLKYSVIVTVHTGDQHQVGNETTGHGTTATITPQAPTSEIQLTDYGALTLDCSPRTGLDFNEMVLLTMKEKSWLVHKQWFLDLPLPWASGASSPQETWNRQDLLVTFKTAHAKKQEVVVLGSQEGAMHTALTGATEIQTSGTTTIFAGHLKCRLKMDKLTLKGMSYVMCTGSFKLKKEVAETQHGTVLVQVEYEGTDAPCKIPFTTQDEKGVIQNGRLITANPIVTDKEKPVNIEAEPPFGESYMVIGVGDKALKLSWFKKGSSLGKMFEATARGARRMAILGDTAWDFGSVGGVFTSMGKLVHQIFGTAYGVLFSGVSWTMKIGIGLLLTWLGLNSRSTSLSMTCIAVGIITLYLGVMVQADTGCVVNWKGRELKCGSGIFVTNEVHTWTEQYKFQADSPKRLSAAIGKAWEDGVCGIRSATRLENIMWKQIANELNYILLENDMKFTVVVGDVKGILTQGKKGIRPQPMEHKYSWKSWGKAKIIGADVQNTTFIIDGPDTPECPDSQRAWNIWEVEDYGFGIFTTNIWLKLRDSYTQVCDHRLMSAAIKDSRAVHADMGYWIESEKNETWKLSRASFIEVKTCTWPKSHTLWSNGVLESEMIIPKIYGGPISQHNYRPGYFTQTAGPWHLGKLELDFDLCEGTTVVVDEQCGNRGPSLRTTTVTGKIIHEWCCRSCTLPPLRFKGEDGCWYGMEIRPVKEKEENLVKSMVSAGSGKVDNFSLGLLCISIMVEEVMRSRWSGKMLMTGTMAVFLLLVMGQLTWNDLIRVCIMVGAHALDSMGMGTTYLALMATFKIRPMLAVGLLFRKLTSREILLLTIGLSLITPVELPNSIEELGDGLAMGIMMLKLLTDFQPYQLWATLLSLTFVKTTLSLHYAWKTAAMVLSIVSLLPLCLSTTSQKTTWLPILLGSLGCKPLTMFLISENKIWGRRSWPINEGIMAVGIVSILMSSLLKNDVPLAGPLIAGGMLVACYVISGSSADLTLEKTAEVSWEEEAEHSGTAHNILVEVQDDGTMKIKDEEREDTLTILLKAALLALSGVYPMSIPATLFVWYFWQKKKQRSGVLWDIPSPPEVEKAVLDDGIYRILQRGVFGRSQVGVGVFQEGVFHTMWHVTRGAVLTYQGKRLEPSWASVKKDLISYGGGWRLQGSWNVGEEVQVIAVEPGKNPKNVQTVPGTFKTHEGEVGAIALDFKPGTSGSPIVNRDGKVVGLYGNGVVTTSGTYVSAIAQSKVSQEGPLPEIEDEVFKKKNLTIMDLHPGSGKTRRYLPAIVRESIKRRLRTLILAPTRVVASEMAEALKGLPIRYQTTAVRNEHTGREIVDLMCHATFTMRLLSPVRVPNYNMIIMDEAHFTDPASIAARGYISTRVGMGEAAAIFMTATPPGSAEAFPQSNSVIYDEEKDIPERSWNSGYDWITDFQGKTVWFVPSIKTGNDIANCLRKNGKRVIQLSRKTFDTEYQKTKNSDWDFVVTTDISEMGANFRADRVIDPRRCLKPVILRDGPERVILAGPMPVTVASAAQRRGRIGRNQSKEGDQYIYMGQPLNNDEDHAHWTEAKMLLDNINTPEGIIPALFEPEREKSAAIDGEYRLRGEARKTFVELMRRGDLPVWLSYKVASEGIQYADRKWCFDGERNNQILEENMDVEIWTKEGERKKLRPRWLDARTYSDPLALREFKEFAAGRRSVSGDLILEIGKLPHHLTQRAQNALDNLVMLHNSEQGGRAYRHAMEELPDTIETLMLLAMIATLTGGVALFFLSGKGLGKTSIGLLCVMASSTLLWMASVEPHWIAASIVLEFFLMVLLIPEPDRQRTPQDNQLAYVVIGLLVLILTVAANEMGLLETTKKDLGIGSAAAEIQHHTTILDVDLHPASAWTLYAVATTVITPMLRHTIENTTANMSLTAIANQAAILMGLDKGWPISKMDIGVPLLALGCYSQVNPMTLTAAVLMLVAHYAIIGPGLQAKATRDAQKRTAAGIMKNPTVDGIVAIDLDPVVYDTKFEKQLGQIMLLILCTSQILLMRTTWAFCESITLATGPLTTLWEGSPGKFWNTTIAVSMANIFRGSYLAGAGLAFSLMKSLGGNRRGTGAQGETLGEKWKRQLNQLSKLEFNTYKRSGIMEVDRTEAKEGLKRGETTRHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKVLNPYMPSVVETLERMQRKHGGMLVRNPLSRNSTHEMYWVSCGTGNIVSAVNMTSRMLLNRFTMTHRKPTYEKDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPKAKRGTAQVMEITAGWLWKFLSRKKKPRICTREEFTRKVRSNAAIGAVFVDENQWNSAKEAVDDERFWDLVNRERELHKQGKCATCVYNMMGKREKKLGEFGKAKGSRAIWYMWLGARFLEFEALGFMNEDHWFSRDNSLSGVEGEGLHKLGYILRDIARIPGGNMYADDTAGWDTRITEEDLQNEARVTELMEPDHAQLATSIFRLTYQNKVVRVQRPGKNGTVMDVISRRDQRGSGQVGTYGLNTFTNMEAQLIRQMESEGVFSPSELETPNLANRVLDWLEKYGVERLKRMAISGDDCVVKPIDDRFATALTALNDMGKVRKDIPQWEPSRGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVTSWEDVPYLGKREDQWCGSLIGLSARATWAINIQVAINQVRKLIGNEHYQDYMTSMRRFKNESEPEGALW

SEQ ID NO: 3717 - protein, 3292 aa, Artificial Sequence
  derived and/or modified protein sequence (wt) from DENV-1__DQ285561__SS-prME
SVTMLLMLLPTALTFHLTTRGGEPHMIVGKQERGKSLLFKTSAGVNMCTLIAMDLGELCDDTMTYKCPRITETEPDDVDCWCNATETWVTYGTCSQTGEHRRDKRSVALAPHVGLGLETRTETWMSSEGAWRQIQKVETWALRHPGFTVIALFLAHAIGTSITQKGIIFILLMLVTPSMAMRCVGIGNRDFVEGLSGATWVDVVLEHGSCVTTMAKDKPTLDIELLKTEVTNPAVLRKLCIEAKISNTTTDSRCPTQGEATLVEEQDTNFVCRRTFVDRGWGNGCGLFGKGSLITCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQEIWNRQDLLVTFKTAHAKKQEVVVLGSQEGAMHTALTGATEIQTSGTTTIFAGHLKCRLKMDKLTLKGISYVMCTGSFKLEKEVAETQHGTVLVQVKYEGTDAPCKIPFSSQDEKGVTQNGRLVTANPIVTDKEKPVNIEAEPPFGESYIVVGAGEKALKLSWFKKGSSIGKMFEATARGARRMAILGDTAWDFGSIGGVFTSVGKLVHQIFGTAYGVLFSGVSWTMKIGIGILLTWLGLNSRSTSLSMTCIAVGMITLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVSGILAQGKKSIRPQPMEHKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFLLLTMGQLTWNDLIRLCIMVGANASDNMGMGTTYLALMATFRMRPMFAVGLLFRRLTSREVLLLTVGLSLVASVELPNSLEELGDGLAMGIMILKLLTDFQSHQLWATLLSLTFVKTTFSLHYAWKTMAMILSIVSLFPLCLSTTSQKTTWLPVLLGSLGCKPLTMFLITENKIWGRKSWPLNEGIMAVGIVSILLSSLLKNDVPLAGPLIAGGMLIACYVISGSSADLSLEKAAEVSWEEEAEHSGASHNILVEIQDDGTMKIKDEERDDTITILLKATLLAISGVYPMSIPATLFVWYFWQKKKQRSGVLWDTPSPPEVERAVLDDGIYRILQRGLLGRSQVGVGVFQEGVFHTMWHVTRGAVLMYQGKRLEPSWASVKKDLISYGGGWRFQGSWNTGEEVQVIAVEPGKNPKNVQTAPGTFKTSEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLVLAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEEKDIPERSWNSGYDWITGFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGKAYRHAMEELPDTIETLMLLALIAVLTGGVTLFFLSGRGLGKTSIGLLCVMSSSALLWMASVEPHWIAASIILEFFLMVLLIPEPDRQRTPQDNQLAYVVIGLLFMILTVAANEMGLLETTKKDLGIGHAAAENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNIYKRSGIVEVDRSEAKEGLKRGETIKHAVSRGTAKLRWFVERNLVKPEGKVIDLGCGRGGWSYYCAGLKKVTEVKGYTKGGPGHEEPIPMATYGWNLVKLYSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVRRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMGAQLIRQMESEGIFSPSELETPNLAGRVLDWLEKHGIERLRRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEDVPYLGKREDQWCGSLIGLTARATWATNIQVAINQVRRLIGNENYLDYMTSMKRFKNESDPEGALW

SEQ ID NO: 3718 - protein, 3292 aa, Artificial Sequence
  derived and/or modified protein sequence (wt) from DENV-1__DQ285562__SS-prME
SVTMLLMLLPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWRQIQKVETWALRHPGFTVIALFLAHTIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGVSYVMCTGSFKLEKEVAETQHGTVLVQVKYEGTDAPCKIPFSTQDEKGVTQNGRLITANPIVTDKEKPVNIETEPPFGESYIVIGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIVVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILTQGKKMIRPQPMEHKYSWKSWGKAKIIGADIQNTTFIIDGPDTPECPDDQRAWNIWEVEDYGFGIFTTNIWLKLRDSYTQMCDHRLMSAAIKDSKAVHADMGYWIESEKNETWKLARASFIEVKTCIWPRSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVRSMVSAGSGEVDSFSLGLLCVSIMVEEVMRSRWSRKMLMTGTLAVFFLLIMGQLTWNDLIRLCIMVGANVSDRMGMGTTYLALMATFKMRPMFAVGLLFRRLTSREVLLLTIGLSLVASVELPNSLEELGDGLAMGIMMLKLLTDFQSHQLWTTLLSLTFIKTTLSLDYAWKTIAMVLSIVSLFPLCLSTTSQKTTWLPVLLGSFGCKPLTMFLITENKIWGRKSWPLNEGIMAVGIVSILLSSLLKNDVPLAGPLIAGGMLITCYVISGSSADLSLEKAAEVSWEEEAEHSGASHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVMASSVLLWMASVEPHWIAASIILEFFLMVLLIPEPDRQRTPQDNQLAYVVIGLLFMILTVAANEMGLLETTKKDLGIGHAVAENHHHATMLDIDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEIANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRPKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNVYADDTAGWDTRITEDDLQNEAKITDIMEPEHALLATSIFKLTYQNKVVRVQRPAKSGTVMDIISRRDQRGSGQVGTYGLNTFTNMEVQLIRQMESEGIFSPSELENSNLAERVLDWLEKHGVERLKRMAISGDDCVVKPTDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEDVPYLGKREDQWCGSLIGLTARATWATNIQVAIKQVRRLIGNENYLDYMTSMKRFKNESDPEGALW

SEQ ID NO: 3719 - protein, 3292 aa, Artificial Sequence
  derived and/or modified protein sequence (wt) from DENV-1__DQ285558__SS-prME
SVTMLLMLLPTALTFHLTTRGGEPHMIVGKQERGKSLLFKTSAGVNMCTLIAMDLGELCDDTMTYKCPRITETEPDDVDCWCNATETWVTYGTCSQTGEHRRDKRSVALAPHVGLGLETRTETWMSSEGAWRQIQKVETWALRHPGFTVIALFLAHAIGTSITQKGIIFILLMLVTPSMAMRCVGIGNRDFVEGLSGATWVDVVLEHGSCVTTMAKDKPTLDIELLKTEVTNPAVLRKLCIEAKISNTTTDSRCPTQGEATLVEEQDTNFVCRRTFVDRGWGNGCGLFGKGSLITCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGISYVMCTGSFKLEKEVAETQHGTVLVQVKYEGTDAPCKIPFSSQDEKGVTQNGRLVTANPIVTDKEKPVNIEAEPPFGESYIVVGAGEKALKLSWFKKGSSIGKMFEATARGARRMAILGDTAWDFGSIGGVFTSVGKLVHQIFGTAYGVLFSGVSWTMKIGIGILLTWLGLNSRSTSLSMTCIAVGLITLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVSGILAQGKKSIRPQPMEHKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFLLLTMGQLTWNDLIRLCIMVGANASDNMGMGTTYLALMATFRMRPMFAVGLLFRRLTSREVLLLTVGLSLVASVELPNSLEELGDGLAMGIMILKLLTDFQSHQLWATLLSLTFVKTTFSLHYAWKTMAMILSIVSLFPLCLSTTSQKTTWLPVLLGSLGCKPLTMFLITENKIWGRKSWPLNEGIMAVGIVSILLSSLLKNDVPLAGPLIAGGMLIACYVISGSSADLSLEKAAEVSWEEEAEHSGASHNILVEIQDDGTMKIKDEERDDTITILLKATLLAISGVYPMSIPATLFVWYFWQKKKQRSGVLWDTPSPPEVERAVLDDGIYRILQRGLLGRSQVGVGVFQEGVFHTMWHVTRGAVLMYQGKRLEPSWASVKKDLISYGGGWRFQGSWNTGEEVQVIAVEPGKNPKNVQTAPGTFKTSEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLVLAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEEKDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGKAYRHAMEELPDTIETLMLLALIAVLTGGVTLFFLSGRGLGKTSIGLLCVMSSSALLWMASVEPHWIAASIILEFFLMVLLIPEPDRQRTPQDNQLAYVVIGLLFMILTVAANEMGLLETTKKDLGIGHAAAENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNIYKRSGIVEVDRSEAKEGLKRGETIKHAVSRGTAKLRWFVERNLVKPEGKVIDLGCGRGGWSYYCAGLKKVTEVKGYTKGGPGHEEPIPMATYGWNLVKLYSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVRRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMGAQLIRQMESEGIFSPSELETPNLAGRVLDWLEKHGIERLRRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEDVPYLGKREDQWCGSLIGLTARATWATNIQVAINQVRRLIGNENYLDYMTSMKRFKNESDPEGALW

SEQ ID NO: 3720 - protein, 3292 aa, Artificial Sequence
  derived and/or modified protein sequence (wt) from DENV-1__DQ285559__SS-prME
SVTMLLMLLPTALTFHLTTRGGEPHMIVSKQERGKSLLFKTSVGVNMCTLIAMDLGELCEDTMTYKCPRITEAEPDDVDCWCNATDTWVTYGTCSQTGEHRRDKRSVALAPHVGLGLETRTETWMSSEGAWKQIQKVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLIDYGALTLDCSPRTGLDFNEMVLLTMKGKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKKGSSIGKMFEATARGARRMAILGDTAWDFGSIGGVFTSVGKLTHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKKLSAAIGKAWEEGVCGIRSATRLENIMWKQISNELNYILLENDMKFTVVVGDANGILAQGKKMIRPQPMEHKYSWKSWGKAKIIGADIQNTTFIIDGPDTPECPDDQRAWNIWEVEDYGFGIFTTNIWLKLRDSYTQMCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCVSILIEEVMRSKWSRKMLMTGTLAVFLLLIMGQLTWNDLTRLCIMVGANASDRMGMGTTYLALMATFKMRPMFAVGLLFRRLTSREVLLLTIGLSLVASVELPNSLEELGDGLAMGIMILKLLTDFQPHQLWTTLLSLTFIKTTLSLDYAWKTMAMTLSIVSLFPLCLSTTSQKTTWLPVLLGSFGCKPLTMFLITENKIWGRKSWPINEGIMAVGIVSILLSSLLKNDVPLAGPLIAGGMLIACYVISGSSADLSLEKAAEVSWEEEAEHSGTSHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEEKDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVMASSALLWMASVEPHWIAASIILEFFLMVLLIPEPDRQRTPQDNQLAYVVIGLLFMILTVAANEMGLLETTKKDLGIGHVAAENHHHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLKGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATAIFKLTYQNKVVRVQRPAKSGTVMDVISRRDQRGSGQVGTYGLNTFTNMEAQLIRQMESEGIFLPSELETPNLAKRVLDWLEKYGAERLKRMAISGDDCVVKPIDDRFAKALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMASMKRFKNESDPEGALW

SEQ ID NO: 3721 - protein, 3292 aa, Artificial Sequence
  derived and/or modified protein sequence (wt) from DENV-1__AF311956__SS-prME
SVTMLLMLLPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQKVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGTSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGRAWEEGVCGIRSATRLENIMWKQISNELNHILLENDIKFTVVVGNANGILAQGKKMIRPQPMEHKYSWKSWGKAKIIGADIQNTTFIIDGPDTPECPDEQRAWNIWEVEDYGFGIFTTNIWLKLRDSYTQMCDHRLMSAAIKDSKAVHADMGYWIESEKNETWKLARASFIEVKTCIWPKSHTLWSNGVLESEMIIPKMYGGPISQHNYRPGYFTQTAGPWHLGKLELDFDLCEGTTVVVDEHCGSRGPSLRTTTVTGKIIHEWCCRSCTLPPLRFRGEDGCWYGMEIRPVKEKEENLVRSMVSAGSGEVDSFSLGILCVSIMIEEVMRSRWSRKMLMTGTLAVFLLLIMGQLTWNDLIRLCIMVGANASDKMGMGTTYLALMATFKMRPMFAVGLLFRRLTSREVLLLTIGLSLVASVELPNSLEELGDGLAMGIMMLKLLTEFQPHQLWTTLLSLTFIKTTLSLDYAWKTTAMVLSIVSLFPLCLSTTSQKTTWLPVLLGSFGCKPLTMFLITENEIWGRKSWPLNEGIMAIGIVSILLSSLLKNDVPLAGPLIAGGMLIACYVISGSSADLSLEKAAEVSWEEEAEHSGTSHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGHVAAENHQHATILDVDLHPASAWTLYAVATTVITPMMRHTIENTTANISLTAIANQAAILMGLDKGWPISKMDLGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEVQLIRQMESEGIFFPSELESPNLAERVLDWLEKHGAERLKRMAISGDDCVVKPIDDRFATALIALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 3722 - protein, 3292 aa, Artificial Sequence
  derived and/or modified protein sequence (wt) from DENV-1__AF311958__SS-prME
SVTMLLMLLPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQKVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGTLTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGTSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGRAWEEGVCGIRSATRLENIMWKQISNELNHILLENDIKFTVVVGNANGILAQGKKMIRPQPMEHKYSWKSWGKAKIIGADIQNTTFIIDGPDTPECPDEQRAWNIWEVEDYGFGIFTTNIWLKLRDSYTQMCDHRLMSAAIKDSKAVHADMGYWIESEKNETWKLARASFIEVKTCIWPKSHTLWSNGVLESEMIIPKMYGGPISQHNYRPGYFTQTAGPWHLGKLELDFDLCEGTTVVVDEHCGSRGPSLRTTTVTGKIIHEWCCRSCTLPPLRFRGEDGCWYGMEIRPVKEKEENLVRSMVSAGSGEVDSFSLGILCVSIMIEEVMRSRWSRKMLMTGTLAVFLLLIMGQLTWNDLIRLCIMVGANASDKMGMGTTYLALMATFKMRPMFAVGLLFRRLTSREVLLLTIGLSLVASVELPNSLEELGDGLAMGIMMLKLLTEFQPHQLWTTLLSLTFIKTTLSLDYAWKTTAMVLSIVSLFPLCLSTTSQKTTWLPVLLGSFGCKPLTMFLITEYEIWGRKSWPLNEGIMAIGIVSILLSSLLKNDVPLAGPLIAGGMLIACYVISGSSADLSLEKAAEVSWEEEAEHSGTSHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEEPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGHVAAENHQHATMLDVDLHPASAWTLYAVATTVITPMMRHTIENTTANISLTAIANQAAILMGLDKGWPISKMDLGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGAAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEVQLIRQMESEGIFFPSELESPNLAERVLDWLEKHGAERLKRMAISGDDCVVKPIDDRFATALIALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 3723 - protein, 3292 aa, Artificial Sequence
  derived and/or modified protein sequence (wt) from DENV-1__AF311957__SS-prME
SVTMLLMLLPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQKVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGTSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGRAWEEGVCGIRSATRLENIMWKQISNELNHILLENDIKFTVVVGNANGILAQGKKMIRPQPMEHKYSWKSWGKAKIIGADIQNTTFIIDGPDTPECPDEQRAWNIWEVEDYGFGIFTTNIWLKLRDSYTQMCDHRLMSAAIKDSKAVHADMGYWIESEKNETWKLARASFIEVKTCIWPKSHTLWSNGVLESEMIIPKMYGGPISQHNYRPGYFTQTAGPWHLGKLELDFDLCEGTTVVVDEHCGSRGPSLRTTTVTGKIIHEWCCRSCTLPPLRFRGEDGCWYGMEIRPVKEKEENLVRSMVSAGSGEVDSFSLGILCVSIMIEEVMRSRWSRKMLMTGTLAVFLLLIMGQLTWNDLIRLCIMVGANASDKMGMGTTYLALMATFKMRPMFAVGLLFRRLTSREVLLLTIGLSLVASVELPNSLEELGDGLAMGIMMLKLLTEFQPHQLWTTLLSLTFIKTTLSLDYAWKTTATVLSIVSLFPLCLSTTSQKTTWLPVLLGSFGCKPLTMFLITENEIWGRKSWPLNEGIMAIGIVSILLSSLLKNDVPLAGPLIAGGMLIACYVISGSSADLSLEKAAEVSWEEEAEHSGTSHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSSDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGHVAAENHQHATMLDVDLHPASAWTLYAVATTVITPMMRHTIENTTANISLTAIANQAAILMGLDKGWPISKMDLGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEVQLIRQMESEGIFFPSELESPNLAERVLDWLEKHGAERLKRMAISGDDCVVKPIDDRFATALIALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 3724 - protein, 3292 aa, Artificial Sequence
  derived and/or modified protein sequence (wt) from DENV-1__EU280167__SS-prME
SVTMLLTLMPTALAFHLTTRGGEPHMIVSKQERGKSLLFKTSAGVNMCTLIAMDLGELCEDTVTYKCPRITEAEPDDVDCWCNATDTWVTYGTCSQTGEHRRDIRSVALAPHVGLGLETRTETWMSSEGAWKQIQRVDTCVLRHPGFTVIALFLAHAIGTSISQKGIIFILLMLVTPSMTMRCVGIGSRDFVEGLSGATWVDVVLEHGSCVTSMAKDKPTLDIELLKTEVPNPAVLRKLCIEAKISNTTTDSRCPTQGEATLVEEQDANFVCRRTFVDRGWGNGCGLFGKGSLLTCDKFKCVTKLEGKIIQYENFKYSVIVTVHTGDQHQVGNESTEHGTTATITPQAPTTEIQLTDYGALTLDCSPRTGLDFNEMVLLTMKEKSWLVHKQWFLDLPLPWTSGASTSRETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGVGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRGLKCGSGIFVTNEVHTWTGQYKFQADSPKGLSAAIGKAWEEGVCGIRSATRLENIMWKQISNELNHILLENDMKFTVVVGDVAGILAQGKKMIRPQPMEHKYSWKNWGKAKIIGADVQNSTFIIDGPNTPECSDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLGTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFRSHQLWATLLSMTFIKTAFSLHYAWKTMAMVLSIVSLFPLCLYTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWCFWQKKKQRSGVLWDTPSPPKVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKMRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKAGNDITNCLRKNGKRVIQLSRKTFDTEYQKTKNNDWDYVVTTDISEMGANFRADRVMDPRRCLKPVILKDGPERVILAGPMPVTVASAAQRRGRIGRNHNKEGDQYIYMGQPLTNDEDHAHWTEAKMLLDNINTPEGIIPALFEPEREKSAAIDGEYRLRGEARKTFVELMRRGDLPVWLSHKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGKGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTIDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMVVTARWLWSFLSRNKKPRICTREEFTRKVRSNAAIGAVFVDENQWNSAKEAVEDDRFWDLVHRERELHKQGKCATCVYNTMGKREKKLGEFGKAKGSRAIWYMWLGARFLEFEALGFMNEDHWFSRENSLSGVEGEGLHKLGYILRDISKIPGGNMYADDTAGWDTRITEGDLQNEAKITDIMEPEHALLAKSIFKLTYQNKVVRVQRPAKNGTVMDVISRRDQRGSGQVGTYGLNTFTNMEAQLIRQMESEGIFSPNELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTRISSWEDVPYLGEREDQWCGSLIGLTARATWATNVQVAINQVRRLIGNENYSDYMTSMKRFKNKSEPEGALW

SEQ ID NO: 3725 - protein, 3291 aa, Artificial Sequence
  derived and/or modified protein sequence (wt) from DENV-2__AJ968413__SS-prME
TAGMIIMLIPTVMAFHLTTRNGEPHMIVSRQEKGKSLLFKTEDGVNMCTLMAMDLGELCEDTITYKCPLLRQNEPEDIDCWCNSTSTWVTYGTCTTTGEHRREKRSVALVPHVGMGLETRTETWMSSEGAWKHAQRIETWILRHPGFTLMAAILAYTIGTTHFQRALIFILLTAVAPSMTMRCIGISNRDFVEGVSGGSWVDIVLEHGSCVTTMAKNKPTLDFELIKTEAKQLATLRKYCIEAKLTNTTTESRCPTQGEPSLNEEQDKRFVCKHSMVDRGWGNGCGLFGKGGIVTCAMFTCKKNMEGKIVQPENLEYTIVITPHSGEEHAVGNDTGKHGKEIKITPQSSITEAELTGYGTVTMECSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVVRVQYEGDGSPCKIPFEIMDLEKRHVLGRLITVNPIVTEKDSPVNIEAEPPFGDSYVIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGVVVQADSGCVVSWKNKELKCGSGIFITDNVHTWTEQYKFQPESPSKLASAIQKAHQEGICGIRSVTRLENLMWKQITPELNHILSENEVKLTIMTGDIKGIMHAGKRSLRPQPTELRYSWKTWGKAKILSTESHNQTFLIDGPETAECPNTNRAWNSLEVEDYGFGVFTTNIWLKLREKQDVFCDSKLMSAAIKDNRAVHADMGYWIESALNDTWKIEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHATLLVAVSFVTLITGNMSFRDLGRVMVMVGATMTDDIGMGVTYLALLAAFKVRPTFAAGLLLRKLTSKELMMTTIGVVLLSQSTIPETILELTDALALGMMVLKIVRKMERYQLAVTITAILCVPNAVILQNAWKVSCTILAVVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELEKAADVRWEDQAEISGSSPILSITISEDGSMSIKNEEEEQTLTILIRTGLLVISGLFPVSIPITAAAWYLWEVKKQRAGVLWDVPSPPPVGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIIDKKGKVVGLYGNGVVTRNGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRRWCFDGIRNNQILEENVEVEIWTKEGERKKLKPRWLDARIYSDPLALKEFKEFAAGRKSLTLNLITEMGRLPTFMTQKARDALDNLAVLHTAEAGGRAYNHALSELPETLETLLLLTLLATVTGGIFLFLMSGRGIGKMTLGMCCIITASILLWYAQIQPHWIAASIILEFFLIVLLIPEPEKQRTPQDNQLTYVVIAILTVVAATMANEMGFLEKTKKDLGLGSITTQQPESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLVLCVTQVLMMRTTWALCEALTLATGPISTLWEGNPGRFWNTTIAVSMANIFRGSYLAGAGLLFSIMKNTTNTRRGTGNIGETLGEKWKNRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTVEAGRTLRVLNLVENWLNNNIQFCIKVLNPYMPSVIEKMEALQRKYGGALVRNPLSRNSTHEMYWVSNASGNIVSSVNMISRMLINRFTMKHKKATYEPDVDLGSGTRNIGIESEVPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDSRFWGLVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKSIQHLTVTEEIAVQNWLARVGRERLSRMAISGDDCVVKPLDDRFASALTALNDMGKVRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIQENPWMEDKTPVESWEEIPYLGKREDQWCGSLIGLTSRATWAKNIQTAINQVRSLIGNEEYTDYMPSMKRFRREEEEAGVLW

SEQ ID NO: 3726 - protein, 3291 aa, Artificial Sequence
  derived and/or modified protein sequence (wt) from DENV-2__AB543624__SS-prME
SAGMIIMLIPTVMAFHLTTRNGEPHMIVGIQEKGKSLLFKTEDGVNMCTLMAMDLGELCEDTITYKCPLLRQNEPEDIDCWCNSTSTWVTYGTCTTTGEHRREKRSVALVPHVGMGLETRTETWMSSEGAWKHAQRIETWILRHPGFTIMAAILAYTIGTTHFQRVLIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLKEEQDKRFVCKHSMVDRGWGNGCGLFGKGGIVTCAMFTCKKNMEGKIVQPENLEYTIVVTPHSGEEHAVGNDTGKHGKEIKVTPQSSITEAELIGYGTVTMECSPRTGLDFNEMVLLQMENKAWLVHRQWFLDLPLPWLPGADKQESNWIQKETLVTFKNPHAKKQDVVVLGSPEGAMHTALTGATEIQMSSGNLLFTGHLKCRLRMDKLQLKGMSYSMCTGKFKVVKEIAETQHGTIVIRVQYEGDGSPCKIPFEIMDLEKRYVLGRLITVNPIVTEKDNPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGIVTLYLGVMVQADSGCVVSWKNKELKCGSGIFITDNVHTWTEQYKFQPESPSKLASAIQKAQEEGICGIRSVTRLENLMWKQIAPELNHILAENEVKLTIMTGDIKGIMQAGKRSLRPQPTELKYSWKTWGKAKMLSTESYNQTFLIDGPETAECPNTNRAWNSLEVEDYGFGVFTTNIWLKLKERQDAFCDSKLMSAAIKDNRAVHADMGYWIESALNDTWKIEKASFIEVKNCHWPKSHTLWSNGVLESEMIIPKNLAGPVSQHNYRPGYHTQIAGPWHLGKLEMDFDFCDGTTVIVTEDCGNRGPSLRTTTASGKLITEWCCRSCTLPPLRYRGEDGCWYGMEIRPLKEKEENLVNSLVTAGHGQVDNFSLGVLGMALFLEEMLRTRVGTKHAILLVAVSFVTLITGNMSFKDLGRVVVMVGATMADDIGMGVTYLALLAAFKVRPTFAAGLLLRKLTSKELMMTTIGIVLLSQSTIPETVLELTDALALGMMVLKIVRNMEKYQLAVTIMAILCVPNAVILQNAWKVSCTILAVVSVSPLLLTSSQQKTDWIPLALTIKGLNPTAIFLTTLSRTNKKRSWPLNEAIMAVGMVSILASSLLKNDIPMTGPLVAGGLLTVCYVLTGRSADLELERATDVKWEDQAEISGSSPILSITISEDGSMSIKNEEEEQTLTILIRTGLLVISGLFPISIPITAAAWYLWEVKKQRAGVLWDVPSPPPMGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNNGTIGAVSLDFSPGTSGSPIIDKKGKVVGLYGNGVVTRSGAYVSAIAQTEKSIEDNPEIEDDIFRKRRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIIDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRRWCFDGIKNNQILEENVEVEIWTKEGERKKLKPRWLDARIYSDPLALKEFKEFAAGRKSLTLNLITEMGRLPTFMTQKTRDALDNLAVLHTAEAGGRAYNHALSELPETLETLLLLTLLATVTGGIFLFLMSGRGIGKMTLGMCCIITASILLWYAQIQPHWIAASIILEFFLIVLLIPEPEKQRTPQDNQLTYVVIAILTVVAATMANEMGFLEKTKKDLGLGSIATQHPESNILDIDLRPASAWTLYAVATTFITPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLILCVTQVLMMRTTWALCEALTLATGPISPLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFIPPEKCDTLLCDIGESSPNPTVEAGRTLRVLNLVENWLNNHTHFCIKVLNPYMPSVLEKMEALQRKYGGALVRNPLSRNSTHEMYWVSNASGNIVSSVNMISRMLINRFTMRHKKATYEPDVDLGSGTRNIGIESEIPNLDIIGKRIEKIKQEHETSWHYDQDHPYKTWAYHGSYETKQTGSASSMVNGVVRLLTKPWDVLPTVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKNIQRLTVTEEVAVHNWLARVGRERLSRMAISGDDCVVKPLDDRFANALTALNDMGKIRKDIQQWEPSKGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIRENPWMEDKTPVESWEEIPYLGKREDQWCGSLIGLTSRATWAKNIQAAINQVRSLIGNEEYTDYMPSMKRFRREEEEAGVLW

SEQ ID NO: 3727 - protein, 3291 aa, Artificial Sequence
  derived and/or modified protein sequence (wt) from DENV-2__AB189122__SS-prME
TAGVIIMMIPTVMAFHLTTRNGEPHMIVSRQEKGKSLLFKTENGVNMCTLMAMDLGELCEDTITYNCPLLRQNEPEDIDCWCNSTSTWVTYGTCTATGEHRREKRSVALAPHVGMGLETRTETWMSSEGAWKHAQRIETWVLRHPGFTIMAAILAYTIGTTYFQRVLIFILLTAVAPSMTMRCIGISNRDFVEGVSGGSWVDIVLEHGSCVTTMAKNKPTLDFELIKTEAKHPATLRKYCIEAKLTNTTTASRCPTQGEPSLNEEQDKRFVCKHSMVDRGWGNGCGLFGKGGIVTCAMFTCKKNMEGKVVQPENLEYTIVITPHSGEENAVGNDTGKHGKEIKVTPQSSITEAELTGYGTVTMECSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVVITWIGMNSRSTSLSVSLVLVGVVTLYLGVMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKAWGKAKMLSTELHNHTFLIDGPETAECPNTNRAWNSLEVEDYGFGVFTTNIWLKLKERQDVFCDSKLMSAAIKDNRAVHADMGYWIESALNDTWKIEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMTTIGIVLLSQSTIPETILELTDALALGMMVLKIVRNMEKYQLAVTIMAILCVPNAVILQNAWKVSCTTLAVVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVRWEEQAEISGSSPILSITISEDGSMSIKNEEEEQTLTILIRTGLLVISGLFPVSIPITAAAWYLWEVKKQRAGVLWDVPSPPPVGKAELEDGAYRIKQKGILGYSQIGVGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIVDKKGKVVGLYGNGVVTRSGTYVSAIAQTEKNIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPIRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYIKTRTNDWDFVVTTDISEMGANFKAERVIDPRRCMKPVILTDGEERVILAGPMPVTHSSAAQRRGRVGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGVKNNQILEENVEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASVLLWYAQIQPHWIAASIILEFFLIVLLIPEPEKQRTPQDNQLTYVVIAILTVVAATMANEMGFLEKTKKDFGLGSIATQQPESNILDIDLRPASAWTLYAVATTFITPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLVLCVTQVLMMRTTWALCEALTLATGPISTLWEGNPGRFWNTTIAVSMANIFRGSYLAGAGLLFSIMKNTANTRRGTGNTGETLGEKWKNRLNALGKSEFQVYKKSGIQEVDRTLAKEGIERGETDHHAVSRGSAKLRWFVERNLVTPEGKVVDLGCGRGGWSYYCGGLKNVKEVKGLTKGGPGHEEPIPMSTYGWNLVRLQSGVDVFFTPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESEIPNLDIIGKRIEKIKQEHETSWHYDQDHPYKTWAYHGSYETKQTGSASSMVNGVVRLLTKPWDVIPMVTQMAMTDTTPFGQQRVFKEKVDTRTQEPKEGTKKLMKITAEWLWKELGKKKTPRMCTREEFTRKVRSNAALGAIFTDENKWKSAREAVEDSGFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVVTYGLNTFTNMEAQLIRQMEGEGVFKSIQHLTVTEEIAVKNWLARVGRERLSRMAISGDDCVVKPLDDRFASALTALNDMGKVRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHATHEWMTTEDMLTVWNRVWIQENPWMEDKTPVESWEEIPYLGKREDQWCGSLIGLTSRATWAKNIQTAINQVRSLIGNEEYTDYMPSMKRFRREEEEAGVLW

SEQ ID NO: 3728 - protein, 3291 aa, Artificial Sequence
  derived and/or modified protein sequence (wt) from DENV-2__AB189123__SS-prME
TAGVIIMMIPTVMAFHLTTRNGEPHMIVSRQEKGKSLLFKTENGVNMCTLMAMDLGELCEDTITYNCPLLRQNEPEDIDCWCNSTSTWVTYGTCTATGEHRREKRSVALAPHVGMGLETRTETWMSSEGAWKHAQRIETWVLRHPGFTIMAAILAYTIGTTYFQRVLIFILLTAVAPSMTMRCIGISNRDFVEGVSGGSWVDIVLEHGSCVTTMAKNKPTLDFELIKTEAKHPATLRKYCIEAKLTNTTTASRCPTQGEPSLNEEQDKRFVCKHSMVDRGWGNGCGLFGKGGIVTCAMFTCKKNMEGKVVQPENLEYTIVITPHSGEENAVGNDTGKHGKEIKVTPQSSITEAELTGYGTVTMECSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVVITWIGMNSRSTSLSVSLVLVGVVTLYLGVMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKAWGKAKMLSTELHNHTFLIDGPETAECPNTNRAWNSLEVEDYGFGVFTTNIWLKLKERQDVFCDSKLMSAAIKDNRAVHADMGYWIESALNDTWKIEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMTTIGIVLLSQSTIPETILELTDALALGMMVLKIVRNMEKYQLAVTIMAILCVPNAVILQNAWKVSCTTLAVVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVRWEEQAEISGSSPILSITISEDGSMSIKNEEEEQTLTILIRTGLLVISGLFPVSIPITAAAWYLWEVKKQRAGVLWDVPSPPPVGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIVDKKGKVVGLYGNGVVTRSGTYVSAIAQTEKNIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPIRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYIKTRTNDWDFVVTTDISEMGANFKAERVIDPRRCMKPVILTDGEERVILAGPMPVTHSIAAQRRGRVGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGVKNNQILEENVEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASVLLWYAQIQPHWIAASIILEFFLIVLLIPEPEKQRTPQDNQLTYVVIAILTVVAATMANEMGFLEKTKKDFGLGSIATQQPESNILDIDLRPASAWTLYAVATTFITPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLVLCVTQVLMMRTTWALCEALTLATGPISTLWEGNPGRFWNTTIAVSMANIFRGSYLAGAGLLFSIMKNTANTRRGTGNTGETLGEKWKNRLNALGKSEFQIYKKSGIQEVDRTLAKEGIERGETDHHAVSRGSAKLRCFVERNLVTPEGKVVDLGCGRGGWSYYCGGLKNVKEVKGLTKGGPGHEEPIPMSTYGWNLVRLQSGVDVFFTPPEKCDTLLCDIGESSPNPTVEAGRTLRVLNLVENWLKNNTQFCIKVLNPYMPSVIEKMEALQRKYGGALVRNPLSRNSTHEMYWVSNASGNIVSSVNMISRMLINRFTMRHKKATYEPDVDLGSGTRNIGIESEIPNLDIIGKRIEKIKQEHETSWHYDQDHPYKTWAYHGSYETKQTGSASSMVNGVVRLLTKPWDVIPMVTQMAMTDTTPFGQQRVFKEKVDTRTQEPKEGTKKLMKITAEWLWKELGKKKTPRMCTREEFTRKVRSNAALGAIFTDENKWKSAREAVEDSGFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVLDIISRRDQRGSGQVVTYGLNTFTNMEAQLIRQMEGEGVFKSIQHLTVTEEIAVKNWLARVGRERLSRMAISGDDCVVKPLDDRFASALTALNDMGKVRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHATHEWMTTEDMLTVWNRVWIQENPWMEDKTPVESWEEIPYLGKREDQWCGSLIGLTSRATWAKNIQTAINQVRSLIGNEEYTDYMPSMKRFRREEEEAGVLW

SEQ ID NO: 3729 - protein, 3291 aa, Artificial Sequence
  derived and/or modified protein sequence (wt) from DENV-2__AB189124__SS-prME
TAGVIIMMIPTVMAFHLTTRNGEPHMIVSRQEKGKSLLFKTENGVNMCTLMAMDLGELCEDTITYNCPLLRQNEPEDIDCWCNSTSTWVTYGTCTATGEHRREKRSVALAPHVGMGLETRTETWMSSEGAWKHAQRIETWVLRHPGFTIMAAILAYTIGTTYFQRVLIFILLTAVAPSMTMRCIGISNRDFVEGVSGGSWVDIVLEHGSCVTTMAKNKPTLDFELIKTEAKHPATLRKYCIEAKLTNTTTASRCPTQGEPSLNEEQDKRFVCKHSMVDRGWGNGCGLFGKGGIVTCAMFTCKKNMEGKVVQPENLEYTIVITPHSGEENAVGNDTGKHGKEIKVTPQSSITEAELTGYGTVTMECSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVVITWIGMNSRSTSLSVSLVLVGVVTLYLGVMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKAWGKAKMLSTELHNHTFLIDGPETAECPNTNRAWNSLEVEDYGFGVFTTNIWLKLKERQDVFCDSKLMSAAIKDNRAVHADMGYWIESALNDTWKIEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMTTIGIVLLSQSTIPETILELTDALALGMMVLKIVRNMEKYQLAVTIMAILCVPNAVILQNAWKVSCTTLAVVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVRWEEQAEISGSSPILSITISEDGSMSIKNEEEEQTLTILIRTGLLVISGLFPVSIPITAAAWYLWEVKKQRAGVLWDVPSPPPVGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIVDKKGKVVGLYGNGVVTRSGTYVSAIAQTEKNIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPIRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYIKTRTNDWDFVVTTDISEMGANFKAERVIDPRRCMKPVILTDGEERVILAGPMPVTHSSAAQRRGRVGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGVKNNQILEENVEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASVLLWYAQIQPHWIAASIILEFFLIVLLIPEPEKQRTPQDNQLTYVVIAILTVVAATMANEMGFLEKTKKDFGLGSIATQQPESNILDIDLRPASAWTLYAVATTFITPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLVLCVTQVLMMRTTWALCEALTLATGPISTLWEGNPGRFWNTTIAVSMANIFRGSYLAGAGLLFSIMKNTANTRRGTGNTGETLGEKWKNRLNALGKSEFQIYKKSGIQEVDRTLAKEGIERGETDHHAVSRGSAKLRWFVERNLVTPEGKVVDLGCGRGGWSYYCGGLKNVKEVKGLTKGGPGHEEPIPMSTYGWNLVRLQSGVDVFFTPPEKCDTLLCDIGESSPNPTVEAGRTLRVLNLVENWLKNNTQFCIKVLNPYMPSVIEKMEALQRKYGGALVRNPLSRNSTHEMYWVSNASGNIVSSVNMISRMLINRFTMRHKKATYEPDVDLGSGTRNIGIESEIPNLDIIGKRIEKIKQEHETSWHYDQDHPYKTWAYHGSYETKQTGSASSMVNGVVRLLTKPWDVIPMVTQMAMTDTTPFGQQRVFKEKVDTRTQEPKEGTKKLMKITAEWLWKELGKKKTPRMCTREEFTRKVRSNAALGAIFTDENKWKSAREAVEDSGFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVVTYGLNTFTNMEAQLIRQMEGEGVFKSIQHLTVTEEIAVKNWLARVGRERLSRMAISGDDCVVKPLDDRFASALTALNDMGKVRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHATHEWMTTEDMLTVWNRVWIQENPWMEDKTPVESWEEIPYLGKREDQWCGSLIGLTSRATWAKNIQTAINQVRSLIGNEEYTDYMPSMKRFRREEEEAGVLW

SEQ ID NO: 3730 - protein, 3291 aa, Artificial Sequence
  derived and/or modified protein sequence (wt) from DENV-2__AB122020__SS-prME
TAGVIVMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKIVQPENLEYTIVITPHSGEEHAVGNDTGKHGKEIKITPQSSTTEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEITDLEKRHVLGRLITVNPIVTEKDSPVNIEAEPPFGDSYIIVGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAMVQADSGCIVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVALSFVTLITGNMSFRDLGRVMVMVGATMTDDIGMGVTYLALLAAFKVRPTFAAGLLLRKLTSKELMMATIGIALLSQSTLPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVGKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGIFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRKWCFDGIKNNQILEENVEVEIWTKEGERKKLKPRWLDARIYSDPLALKEFKEFAAGRKSLTLNLITEMGRLPTFMTQKARNALDNLAVLHTAEVGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGFGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNVGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMETLQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKEKTPRMCTREEFTRKVRSNAALGAIFTDENKWKSAREAVEDGRFWELVDRERNLHLEGKCETCVYNMMGKREKKLGEFGKAKGSRAIWYMWLGARFLEFEALGFLNEDHWFSRGNSLSGVEGEGLHRLGYILREVGKKEGGAMYADDTAGWDTRITLEDLKNEEMVTNHMKGEHKKLAEAIFKLTYQNKVVRVQRPTPRGTVMDIISRKDQRGSGQVGTYGLNTFTNMEAQLIRQMEGEGIFKSIQHLTATEEIAVQNWLARVGRERLSRMAISGDDCVVKPIDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 3731 - protein, 3291 aa, Artificial Sequence
  derived and/or modified protein sequence (wt) from DENV-2__LC121816__SS-prME
TVGMIIMLIPTAMAFHLTTRNGEPHMIVSRQEKGKSLLFKTEDGVNMCTLMAMDLGELCEDTVTYNCPLLRQNEPEDIDCWCNSTSTWVTYGTCTATGEHRREKRSVALVPHVGMGLETRTETWMSSEGAWKHAQRIETWILRHPGFTIMAAILAHTIGTTYFQRVLIFILLTAVAPSMTMRCIGISNRDFVEGVSGGSWVDIVLEHGSCVTTMAKNKPTLDFELIKTEAKQPATLRKYCIEAKLTNTTTASRCPTQGEPSLNEEQDKRFVCKHSMVDRGWGNGCGLFGKGGIVTCAMFTCKKNMEGKIVQPENLEYTIVITPHSGEENAVGNDTGKHGKEVKVTPQSSITEAELTGYGTVTMECSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRHVLGRLITVNPIVTERDSPVNIEAEPPFGDSYIIIGVEPGQLKLSWFKKGSSIGQMFETTMRGAKRMAILGDTAWDFGSLGGVFTSIGKALHQVFGAIYGAAFSGVSWTMKILIGVVITWIGMNSRSTSLSVSLVLVGVVTLYLGVMVQADSGCVVSWKNKELKCGSGIFITDNVHTWTEQYKFQPESPSKLASAIQKAYEEGICGIRSVTRLENLMWKQITPELNHILSENEVKLTIMTGDIKGIMQAGKRSLRPQPTELKYSWKTWGKAKMLSTEHHNQTLLIDGPETAECPNTNRAWNSLEVEDYGFGVFTTNIWLKLKERQDVFCDSKLMSAAIKDNRAVHADMGYWIESALNDTWKIEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHALLLVAVSFMTLITGNMSFRDLGRVMVMVGAAMTDDIGMGVTYLALLAAFKVRPTFAAGLLLRKLTSKELMMTTIGIVLLSQSTIPETILELTDALALGMMILKIVRNMEKYQLAVTIMAILCVPNAVILQNAWKVSCTILAVVSVTPLLLTSSRQKADWIPLALTIKGLNPTAIFLTTLSRTNKKRSWPLNEAIMAVGMVSILASSLLKNDIPMTGPLVAGGLLTVCYVLTGRSADLELERAADVRWEDQAEISGSSPILSITISEDGSMSIKNEEEEQTLTILIRTGLLVISGLFPVSIPITAAAWYLWEVKKQRAGVLWDVPSPPPVGKAELEDGAYRIKQKGILGYSQIGAGVYKEGTFHTMWHVTRGAVLMHKGKRIEPSWADVRKDLISYGGGWKLEGEWKEGEEVQVLALEPGKNPRAVQTKPGLFKTDTGTIGAVSLDFSPGTSGSPIVDKKGKVVGLYGNGVVTRSGTYVSAIAQTEKSIEDNPEIEDDIFRKRRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYIKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGVKNNQILEENVEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDFGLGSIATQQPESNILDIDLRPASAWTLYAVATTFITPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLVLCVTQVLMMRTTWALCEALTLATGPISTLWEGNPGRFWNTTIAVSMANIFRGSYLAGAGLLFSIMKNTTNTRRGTGNTGETLGEKWKNRLNALGKSEFQTYKKSGIQEVDRTLAKEGIKRGETDHHAVSRGSAKLRWFVERNLVTPEGKVVDLGCGRGGWSYYCGGLKNVREVKGLTKGGPGHEEPIPMSTYGWNLVRLQSGVDVFFTPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESETPNLDIIGKRIEKIRQEHETSWHYDQDHPYKTWAYHGSYETKQTGSASSMVNGVVRLLTKPWDVIPMVTQMAMTDTTPFGQQRVFKEKVDTRTQEPKEGTKKLMKITAKWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMGAQLIRQMEGEGVFKSIQHLTATEEIAVQDWLARVGRERLSRMAISGDDCVVKPLDDRFASALTALNDMGKVRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIQENPWMEDKTPVESWEEIPYLGKREDQWCGSLIGLTSRATWAKNIQTAINQVRSLIGNEEYTDYMPSMKRFRREEEEAGVLW

SEQ ID NO: 3732 - protein, 3291 aa, Artificial Sequence
  derived and/or modified protein sequence (wt) from DENV-2__LC111438__SS-prME
TAGIIIMMIPTVMAFHLTTRNGEPHMIVSRQEKGKSLLFKTENGVNMCTLMAMDLGELCEDTITYNCPLLRQNEPEDIDCWCNSTSTWVTYGTCTATGEHRREKRSVALVPHVGMGLETRTETWMSSEGAWKHAQRIETWVLRHPGFTIMAAILAYTIGTTHFQRVLIFILLTAVAPSMTMRCIGISNRDFVEGVSGGSWVDIVLEHGSCVTTMAKNKPTLDFELIKTEAKHPATLRKYCIEAKLTNTTTASRCPTQGEPSLNEEQDKRFVCKHSMVDRGWGNGCGLFGKGGIVTCAMFTCKKNMEGKVVQPENLEYTIVITPHSGEENAVGNDTGKHGKEIKVTPQSSITEAELTGYGTVTMECSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRHVLGRLITVNPIVTEKDSPVNIEAEPPFGDSYIIIGVEPGQLKLSWFKKGSSIGQMFETTMRGAKRMAILGDTAWDFGSLGGVFTSIGKALHQVFGAIYGAAFSGVSWTMKILIGVVITWIGMNSRSTSLSVSLVLVGVVTLYLGVMVQADSGCVVSWKNKELKCGSGIFITDNVHTWTEQYKFQPESPPKLASAIQKAHEEGICGIRSVTRLENLMWKQITPELNHILSENEVKLTIMTGDIKGIMQAGKRSLRPQPTELKYSWKAWGKAKMLSTELHNHTFLIDGPETAECPNTNRAWNSLEVEDYGFGVFTTNIWLKLKEKQDVFCDSKLMSAAIKDNRAVHADMGYWIESALNDTWKIEKASFIEVKSCHWPKSHTLWSNGVLESEMIIPKNFAGPVSQHNYRPGYHTQTAGPWHLGSLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKIRPTFAAGLLLRKLTSKELMMTTIGIVLLSQSTIPETILELTDALALGMMVLKIVRNMEKYQLAVTIMAILCVPNAVILQNAWKVSCTTLAVVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVRWEEQAEISGSSPILSITISEDGSMSIKNEEEEQTLTILIRTGLLVISGLFPVSIPITAAAWYLWEVKKQRAGVLWDVPSPPPVGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIVDKKGKVVGLYGNGVVTRSGTYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPIRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYIKTRTNDWDFVVTTDISEMGANFKAERVIDPRRCMKPVILTDGEERVILAGPMPVTHSSAAQRRGRVGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGVKNNQILEENVEVEIWTKEGERKKLKPRWLDARIYSDPLALKEFKEFAAGRKSLALNLITEMGRLPTFMTQKARNALDNLAVLHTAEAGGRAYNHALSELPETLETLLLLTLLATVTGGIFLFLMSGKGIGKMTMGMCCIITASILLWYAQIQPHWIAASIILEFFLIVLLIPEPEKQRTPQDNQLTYVVIAILTVVAATMANEMGFLEKTKKDFGLGSIATQQPESNILDIDLRPASAWTLYAVATTFITPMLRHSIENSSVNVSLTAIANQATVLMGLGKGWPLSKMDIGVPLLAIGCYSQVNPITLMAALLLLVAHYAIIGPGLQAKATREAQKRAAAGIMKNPTVDGITVIDLDPIPYDPKFEKQLGQVMLLVLCVTQVLMMRTTWALCEALTLATGPISTLWEGNPGRFWNTTIAVSMANIFRGSYLAGAGLLFSIMKNTANTRRGTGNTGETLGEKWKNRLNALGKSEFQIYKKSGIQEVDRTLAKEGIKRGETDHHAVSRGSAKLRWFVERNLVTPEGKVVDLGCGRGGWSYYCGGLKNVKEVKGLTKGGPGHEEPIPMSTYGWNLVRLQSGVDVFFTPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESETPNLDIIGKRIEKIKQEHETSWHYDQDHPYKTWAYHGSYETKQTGSASSMVNGVVRLLTKPWDVIPMVTQMAMTDTTPFGQQRVFKEKVDTRTQEPKEGTKKLMKITAKWLWKELGKKKTPRMCTREEFTRKVRSNAALGAIFTDENKWKSAREAVEDSGFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEIVTNYMEGEHKKLAEAIFKLTYQNKVVRVQRPTPRGTVMDIISRRDQRGSGQVVTYGLNTFTNMEAQLIRQMEGEGVFKSIQHLTVTEEIAVENWLVRVGRERLSRMAISGDDCVVKPLDDRFASALTALNDMGKVRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHATHEWMTTEDMLTVWNRVWIQENPWMEDKTPVESWEEIPYLGKREDQWCGSLIGLTSRATWAKNIQTAINQVRSLIGNEEYTDYMPSMKRFRREEEEAGVLW

SEQ ID NO: 3733 - protein, 3291 aa, Artificial Sequence
  derived and/or modified protein sequence (wt) from DENV-2__KF744400__SS-prME
TAGMIIMLIPTVMAFHLTTRNGEPHMIVSRQEKGKSLLFKTENGVNMCTLMAMDLGELCEDTITYKCPLLRQNEPEDIDCWCNSTSTWVTYGTCTTTGEHRREKRSVALVPHVGMGLETRTETWMSSEGAWKHAQRIETWILRHPGFTLMAAILAYTIGTTHFQRALIFILLTAVAPSMTMRCIGISNRDFVEGVSGGSWVDIVLEHGSCVTTMAKNKPTLDFELIKTEAKEPATLRKYCIEAKLTNTTTESRCPTQGEPSLNEEQDKRFVCKHSMVDRGWGNGCGLFGKGGIVTCAMFTCKKNMEGKIVQPENLEYTIVITPHSGEEHAVGNDTGKHGKEIKITPQSSTTEAELTGYGTVTMECSPRTGLDFNEMVLLQMENKAWLVHRQWFLDLPLPWLPGADTQGSNWIQKETLVTFKNPHAKKQDVVVLGSQEGAMHTALTGATDIQMSSGNLLFTGHLKCRLRMDKLQLKGMSYSMCTGKFKVVKEIAETQHGTIVVRVQYEGDGSPCKIPFEIMDLEKRHVLGRLITVNPIVTEKDSPVNIEAEPPFGDSYVIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGVVVQADSGCVVSWKNKELKCGSGIFITDNVHTWTEQYKFQPESPSKLASAIQKAHQEGICGIRSVTRLENLMWKQITPELNHILSENEVKLTIMTGDIKGIMHAGKRSLRPQPTELRYSWKTWGKAKILSTESHNQTFLIDGPETAECPNTNRAWNSLEVEDYGFGVFTTNIWLKLREKQDAFCDPKLMSAAIKDNRAVHADMGYWIESALNDTWKIEKASFIEVKNCHWPKSHTLWSNGVLESEMIIPKNFAGPVSQHNYRPGYHTQTAGPWHLGKLELDFDFCEGTTVVVTEDCGNRGPSLRTTTASGKLITEWCCRSCTLPPLRYKGEDGCWYGMEIRPLKEKEENLVSSLVTAGHGQIDNFSLGVLGMALFLEEMLRTRVGMKHAILLVAVSFVTLITGNMSFRDLGRVMVMVGATMTDDIGMGVTYLALLAAFKVRPTFAAGLLLRKLTSKELMMTTIGIVLLSQSTIPETILELTDALALGMMVLKIVRKMERYQLAVTIMAILCVPNSVILQNAWKVSCTILAVVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELEKAADVRWEDQAEISGSSPILSVIVSEDGSMSIKNEEEEQILTILIRTGLLVISGLFPVSIPITAAAWYLWEVKKQRAGVLWDVPSPPPVGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNAGTIGAVSLDFSPGTSGSPIIDKKGKVVGLYGNGVVTRNGSYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPIRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRRWCFDGIRNNQILEENVEVEIWTKEGERKKLKPRWLDARIYSDPLALKEFKEFAAGRKSLTLNLITEMGRLPTFMTQKARDALDNLAVLHTAEAGGRAYNHALSELPETLETLLLLTLLATVTGGIFLFLMSGRGIGKMTLGMCCIITASILLWYAQIQPHWIAASIILEFFLIVLLIPEPEKQRTPQDNQLTYVVIAILTVVAATMANEMGFLEKTKKDLGLGSIATQQPESNILDIDLRPASAWTLYAVATTFITPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITAIDLDPIPYDPKFEKQLGQVMLLVLCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMKHKKATYEPDVDLGSGTCNIGIESEVPNLDIIGKRIEKIKQEHETSWHYDQDHPYKTWAYHGSYEAKQTGSASSMVNGVVRLLTKPWDVIPMVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLYKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGIFKSIQHLTATEEIAVQNWLTRVGRERLSRMAISGDDCVVKPLDDRFASALTALNDMGKVRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIQENPWMEDKTPVESWEEIPYLGKREDQWCGSLIGLTSRATWAKNIQTAINQVRSLIGNEEYTDYMPSMKRFRREEEEAGVLW

SEQ ID NO: 3734 - protein, 3291 aa, Artificial Sequence
  derived and/or modified protein sequence (wt) from DENV-2__KF744401__SS-prME
TAGMIIMLIPTVMAFHLTTRNGEPHMIVSRQEKGKSLLFKTENGVNMCTLMAMDLGELCEDTITYKCPLLRQNEPEDIDCWCNSTSTWVTYGTCTTTGEHRREKRSVALVPHVGMGLETRTETWMSSEGAWKHAQRIETWILRHPGFTLMAAILAYTIGTTHFQRALIFILLTAVAPSMTMRCIGISNRDFVEGVSGGSWVDIVLEHGSCVTTMAKNKPTLDFELIKTEAKEPATLRKYCIEAKLTNTTTESRCPTQGEPSLNEEQDKRFVCKHSMVDRGWGNGCGLFGKGGIVTCAMFTCKKNMEGKIVQPENLEYTIVITPHSGEEHAVGNDTGKHGKEIKITPQSSTTEAELTGYGTVTMECSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVVRVQYEGDGSPCKIPFEIMDLEKRHVLGRLITVNPIVTEKDSPVNIEAEPPFGDSYVIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGVVVQADSGCVVSWKNKELKCGSGIFITDNVHTWTEQYKFQPESPSKLASAIQKAHQEGICGIRSVTRLENLMWKQITPELNHILSENEVKLTIMTGDIKGIMHAGKRSLRPQPTELRYSWKTWGKAKILSTESHNQTFLIDGPETAECPNTNRAWNSLEVEDYGFGVFTTNIWLKLREKQDAFCDPKLMSAAIKDNRAVHADMGYWIESALNDTWKIEKASFIEVKNCHWPKSHTLWSNGVLESEMIIPKNFAGPVSQHNYRPGYHTQTAGPWHLGKLELDFDFCEGTTVVVTEDCGNRGPSLRTTTASGKLITEWCCRSCTLPPLRYKGEDGCWYGMEIRPLKEKEENLVSSLVTAGHGQIDNFSLGVLGMALFLEEMLRTRVGMKHAILLVAVSFVTLITGNMSFRDLGRVMVMVGATMTDDIGMGVTYLALLAAFKVRPTFAAGLLLRKLTSKELMMTTIGIVLLSQSTIPETILELTDALALGMMVLKIVRKMERYQLAVTIMAILCVPNSVILQNAWKVSCTILAVVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELEKAADVRWEDQAEISGSSPILSVIVSEDGSMSIKNEEEEQTLTILIRTGLLVISGLFPVSIPITAAAWYLWEVKKQRAGVLWDVPSPPPVGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNAGTIGAVSLDFSPGTSGSPIIDKKGKVVGLYGNGVVTRNGSYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPIRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRRWCFDGIRNNQILEENVEVEIWTKEGERKKLKPRWLDARIYSDPLALKEFKEFAAGRKSLTLNLITEMGRLPTFMTQKARDALDNLAVLHTAEAGGRAYNHALSELPETLETLLLLTLLATVTGGIFLFLMSGRGIGKMTLGMCCIITASILLWYAQIQPHWIAASIILEFFLIVLLIPEPEKQRTPQDNQLTYVVIAILTVVAATMANEMGFLEKTKKDLGLGSIATQQPESNILDIDLRPASAWTLYAVATTFITPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITAIDLDPIPYDPKFEKQLGQVMLLVLCVTQVLVMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMKHKKATYEPDVDLGSGTRNIGIESEVPNLDIIGKRIEKIKQEHETSWHYDQDHPYKTWAYHGSYEAKQTGSASSMVNGVVRLLTKPWDVIPMVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLYKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGIFKSIQHLTATEEIAVQNWLTRVGRERLSRMAISGDDCVVKPLDDRFASALTALNDMGKVRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIQENPWMEDKTPVESWEEIPYLGKREDQWCGSLIGLTSRATWAKNIQTAINQVRSLIGNEEYTDYMPSMKRFRREEEEAGVLW

SEQ ID NO: 3735 - protein, 3291 aa, Artificial Sequence
  derived and/or modified protein sequence (wt) from DENV-2__KF744402__SS-prME
TAGMIIMLIPTVMAFHLTTRNGEPHMIVSRQEKGKSLLFKTEDGVNMCTLMAMDLGELCEDTITYKCPLLRQNEPEDIDCWCNSTSTWVTYGTCTTTGEHRREKRSVALVPHVGMGLETRTETWMSSEGAWKHAQRIETWILRHPGFTLMAAILAYTIGTTNFQRALIFILLTAVAPSMTMRCIGISNRDFVEGVSGGSWVDIVLEHGSCVTTMAKNKPTLDFELIKTEAKHPATLRKYCIEAKLTNTTTESRCPTQGEPSLNEEQDKRFVCKHSMVDRGWGNGCGLFGKGGIVTCAMFTCKKNMEGKIVQPENLEYTIVITPHSGEEHAVGNDTGKHGKEIKVTPQSSITEAELTGYGTVTMECSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVVRVQYEGDGSPCKIPFEIMDLEKRHVLGRLITVNPIVTEKDSPVNIEAEPPFGDSYVIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLILVGVVTLYLGVVVQADSGCVVSWRNKELKCGSGIFITDNVHTWTEQYKFQPESPSKLASAIQKAHQEGICGIRSVTRLENLMWKQITPELNHILSENEVKLTIMTGDIKGIMHAGKRSLRPQPTELRYSWKTWGRAKILSTESHNQTFLIDGPETAECPNTNRAWNSLEVEDYGFGVFTTNIWLKLKERQDVFCDSKLMSAAIKDNRAVHADMGYWIESALNDTWKIEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHTILLVAVSFVTLITGNMSFRDLGRVMVMVGATMTDNIGMGVTYLALLAAFKVRPTFAAGLLLRKLTSKELMMTTIGIVLLSQSTIPETILELTDALALGMMVLKIVRNMEKYQLAVTIMAILCVPNAVILQNAWKVSCTILAVVSVSPLLLTSSQQKADWIPLALTIKGLNPTAIFLTTLSRTSKKRSWPLNEAIMAVGMVSILASSLLKNDIPITGPLVAGGLLTVCYVLTGRSADLELERAADVRWEEQAEISGSSPILSIIISEDGSMSIKNEEEEQTLTILIRTGLLVISGLFPVSIPITAAAWYLWEVKKQRAGVLWDVPSPPPVGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNAGTIGAVSLDFSPGTSGSPIIDKKGKVVGLYGNGVVTRNGSYVSAIAQTGKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPIRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDHAHWKEAKMLLDNINTPEGIIPSMFEPEREKVDAIDGEYRLRGEARKTFVDLMRRGDLPVWLAYKVAAEGINYADRRWCFDGIRNNQILEENVEVEIWTKEGERKKLKPRWLDARIYSDPLALKEFKEFAAGRKSLTLNLITEMGRLPTFMTQKARDALDNLAVLHTAEAGGRAYNHALSELPETLETLLLLTLLATVTGGIFLFLMSGKGIGKMTLGMCCIITASVLLWYAQIQPHWIAASIILEFFLIVLLIPEPEKQRTPQDNQLTYVVIAILTVVAATMANEMGFLEKTKKDFGLGSIATQQPESNILDIDLRPASAWTLYAVATTFITPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLVLCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESEVPNLDIIGKRIEKIKQEHETSWHYDQDHPYKTWAYHGSYETKQTGSASSMVNGVVRLLTKPWDVIPMVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKSIQHLTATEEIAVQNWLARVGRERLSRMAISGDDCVVKPLDDRFASALTALNDMGKVRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIQENPWMEDKTPVESWEEIPYLGKREDQWCGSLIGLTSRATWAKNIQTAINQVRSLIGNEEYTDYMPSMKRFRREEEEAGVLW

SEQ ID NO: 3736 - protein, 3291 aa, Artificial Sequence
  derived and/or modified protein sequence (wt) from DENV-2__KF744408__SS-prME
TAGMIIMLIPTVMAFHLTTRNGEPHMIVSRQEKGKSLLFKTEDGVNMCTLMAMDLGELCEDTITYKCPLLRQNEPEDIDCWCNSTSTWVTYGTCTTTGEHRREKRSVALVPHVGMGLETRTETWMSSEGAWKHAQRIETWILRHPGFTLMAAILAYTIGTTNFQRALIFILLTAVAPSMTMRCIGISNRDFVEGVSGGSWVDIVLEHGSCVTTMAKNKPTLDFELIKTEAKHPATLRKYCIEAKLTNTTTASRCPTQGEPSLNEEQDKRFVCKHSMVDRGWGNGCGLFGKGGIVTCAMFTCKKNMEGKIVQPENLEYTIVITPHSGEEHAVGNDTGKHGKEIKITPQSSITEAELTGYGTVTMECSPRTGLGFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVVRVQYEGDGSPCKIPFEIMDLEKRHVLGRLITVNPIVTEKDSPVNIEAEPPFGDSYVIIGVEPGQLKLSWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGVVVQADSGCVVSWRNKELKCGSGIFITDNVHTWTEQYKFQPESPSKLASAIQKAHQEGICGIRSVTRLENLMWKQITPELNHILSENEVKLTIMTGDIKGIMQAGKRSLRPQPTELRYSWKTWGKAKILSTESHNQTFLIDGPETAECPNTNRAWNSLEVEDYGFGVFTTNIWLRLREKQDAFCDSKLMSAAIKDNRAVHADMGYWIESALNDTWKIEKASFIEVKSCHWPKSHTLWSNGVLESEMIIPKNFAGPVSQHNYRPGYHTQTAGPWHLGKLEMDFDFCKGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMTTIGIVLLSQSTIPETILELTDALALGMMVLKIVRNMEKYQLAVTIMAILCVPNAVILQNAWKVSCTILAVVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELEKAADVRWEDQAEISGSSPILSIIISEDGSMSIKNEEEEQTLTILIRTGLLVISGLFPVSIPITAAAWYLWEVKKQRAGVLWDVPSPPPVGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNAGTIGAVSLDFSPGTSGSPIIDKKGKVVGLYGNGVVTRNGSYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPIRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRRWCFDGIRNNQILEENVEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASVLLWYAQIQPHWIAASIILEFFLIVLLIPEPEKQRTPQDNQLTYVVIAILTVVAATMANEMGFLEKTKKDLGLGSITTQQPESNILDIDLRPASAWTLYAVATTFITPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLVLCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMITPEGKVVDLGCGRGGWSYYCGGLKNVREVKGLTKGGPGHEEPIPMSTYGWNLVRLQSGVDVFFTPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMKHKKATYEPDVDLGSGTRNIGIESEVPNLDIIGKRIEKIKQEHETSWHYDQDHPYKTWAYHGSYETKQTGSASSMVNGVVRLLTKPWDVIPMVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKSIQHLTATEEIAVQNWLARVGRERLSRMAISGDDCVVKPLDDRFASALTALNDMGKVRKDIQQWEPSKGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIQENPWMEDKTPVESWEEIPYLGKREDQWCGSLIGLTSRATWAKNIQTAINQVRSLIGNEEYTDYMPSMKRFRREEEEAGVLW

SEQ ID NO: 3737 - protein, 3291 aa, Artificial Sequence
  derived and/or modified protein sequence (wt) from DENV-2__JX669476__SS-prME
TAGVIVMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKIVQSENLEYTIVITPHSGEEHAVGNDTGKHGKEIKITPQSSTTEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEITDLEKRHVLGRLITVNPIVTEKDSPVNIEAEPPFGDSYIIVGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAMVQADSGCIVSWKNKELKCGSGIFITDNVHTWTEQYKFQPEFPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKVEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVALSFVTLITGNMSFRDLGRVMVMVGATMTDDIGMGVTYLALLAAFKVRPTFAAGLLLRKLTSKELMMATIGIALLSQSTLPETILELTDALALGMMALKIVRNMEKYQLAVTIMAISCVPNAVILQNAWKVSCTILAAVSVSPLLLTSSQQKTDWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVEKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGIFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRKWCFDGIKNNQILEENVEVEIWTKEGERKKLKPRWLDARIYSDPLALKEFKEFAAGRKSLTLNLITEMGRLPTFMTQKARNALDNLAVLHTAEVGGRAYTHALSELPETLETLLLLTLLAAVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGFGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNVGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMETLQRKYGGALVRNPLSRNSTHEMYWVSNATGNIVSSVNMISRMLINRFTMKHKKATYEPDVDLGSGTRNIGIESEIPNLDIIGKRIEKIKQEHEISWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKEKTPRMCTREEFTRKVRSNAALGAVFTDENKWKSAREAVEDDRFWELVDRERNLHLEGKCETCVYNMMGKREKKLGEFGKAKGSRAIWYMWLGARFLEFEALGFLNEDHWFSRGNSLSGVEGEGLHRLGYILREVGKKEGGAMYADDTAGWDTRITLEDLKNEEMVTNHMKGEHKKLAEAIFKLTYQNKVVRVQRPTPRGTVMDIISRKDQRGSGQVGTYGLNTFTNMEAQLIRQMEGEGIFKSIQHLTATEEIAVQNWLARVGRERLSRMAISGDDCVVKPIDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLTVWNRVWIQENPWMEDKTPVESWEEVPYLGKREDQWCGSLIGLTSRATWAKNIQTAINQVRSLIGNEGYTDYMPSMKRFRREEEEAGVLW

SEQ ID NO: 3738 - protein, 3291 aa, Artificial Sequence
  derived and/or modified protein sequence (wt) from DENV-2__JX475906__SS-prME
TVGMIIMLIPTAMAFHLTTRNGEPHMIVSRQEKGKSLLFKTEDGVNMCTLMAMDLGELCEDTVTYNCPLLRQNEPEDIDCWCNSTSTWVTYGTCTATGEHRREKRSVALVPHVGMGLETRTETWMSSEGAWKHAQRIETWILRHPGFTIMAAILAYTIGTTYFQRVLIFILLTAVAPSMTMRCIGISNRDFVEGVSGGSWVDIVLEHGSCVTTMAKNKPTLDFELIKTEAKQPATLRKYCIEAKLTNTTTASRCPTQGEPSLNEEQDKRFVCKHSMVDRGWGNGCGLFGKGGIVTCAMFTCKKNMEGKIVQPENLEYTIVITPHSGEENAVGNDTGKHGKEVKVTPQSSITEAELTGYGTVTMECSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRHVLGRLITVNPIVTEKDSPVNIEAEPPFGDSYIIIGVEPGQLKLSWFKKGSSIGQMFETTMRGAKRMAILGDTAWDFGSLGGVFTSIGKALHQVFGAIYGAAFSGVSWTMKILIGVVITWIGMNSRSTSLSVSLVLVGVVTLYLGVMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTEPHNQTFLIDGPETAECPNTNRAWNSLEVEDYGFGVFTTNIWLKLKERQDVFCDSKLMSAAIKDNRAVHADMGYWIESALNDTWKIEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHALLLVAVSFMTLITGNMSFRDLGRVMVMVGAAMTDDIGMGVTYLALLAAFKVRPTFAAGLLLRKLTSKELMMTTIGIVLLSQSTIPETILELTDALALGMMILKIVRNMEKYQLAVTIMAILCVPNAVILQNAWKVSCTILAVVSVSPLLLTSSRQKADWIPLALTIKGLNPTAIFLTTLSRTNKKRSWPLNEAIMAVGMVSILASSLLKNDIPMTGPLVAGGLLTVCYVLTGRSADLELERAADVRWEDQAEISGSSPILSITISEDGSMSIKNEEEEQTLTILIRTGLLVISGLFPVSIPITAAAWYLWEVKKQRAGVLWDVPSPPPVGKAELEDGAYRIKQKGILGYSQIGAGVYKEGTFHTMWHVTRGAVLMHKGKRIEPSWADVRKDLISYGGGWKLEGEWKEGEEVQVLALEPGKNPRAVQTKPGLFKTNTGTIGAVSLDFSPGTSGSPIVDKKGKVVGLYGNGVVTRSGTYVSAIAQAEKSIEDNPEIEDDIFRKRRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYIKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGVKNNQILEENVEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDFGLGSIATQQPESNILDIDLRPASAWTLYAVATTFITPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLVLCVTQVLMMRTTWALCEALTLATGPISTLWEGNPGRFWNTTIAVSMANIFRGSYLAGAGLLFSIMKNTTNTRRGTGNTGETLGEKWKNRLNALGKSEFQIYKKSGIQEVDRTLAKEGIKRGETDHHAVSRGSAKLRWFVERNLVTPEGKVVDLGCGRGGWSYYCGGLKNVREVKGLTKGGPGHEEPIPMSTYGWNLVRLQSGVDVFFTPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESETPNLDIIGKRIEKIKQEHETSWHYDQDHPYKTWAYHGSYETKQTGSASSMVNGVVRLLTKPWDVIPMVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMGAQLIRQMEGEGVFKSIQHLTATEEIAVQDWLARVGRERLSRMAISGDDCVVKPLDDRFASALTALNDMGKVRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIQENPWMEDKTPVESWEEIPYLGKREDQWCGSLIGLTSRATWAKNIQTAINQVRSLIGNEEYTDYMPSMKRFRREEEEAGVLW

SEQ ID NO: 3739 - protein, 3291 aa, Artificial Sequence
  derived and/or modified protein sequence (wt) from DENV-2__JX669477__SS-prME
TAGVIVMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKIVQPENLEYTIVITPHSGEEHAVGNDTGKHGKEIKITPQSSTTEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEITDLEKRHVLGRLITVNPIVTEKDSPVNIEAEPPFGDSYIIVGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAMVQADSGCIVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVALSFVTLITGNMSFRDLGRVMVMVGATMTDDIGMGVTYLALLAAFKVRPTFAAGLLLRKLTSKELMMATIGIALLSQSTLPETILELTDALALGMMALKIVRNMEKYQLAVTIMAISCVPNTVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVGKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGIFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRKWCFDGIKNNQILEENVEVEIWTKEGERKKLKPRWLDARIYSDPLALKEFKEFAAGRKSLTLNLITEMGRLPTFMTQKARNALDNLAVLHTAEVGGKAHTHALSELPETLETLLLLTLLAAVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGFGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNVGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMETLQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKEKTPRMCTREEFTRKVRSNAALGAVFTDENKWKSAREAVEDGRFWELVDRERNLHLEGKCETCVYNMMGKREKKLGEFGKAKGSRAIWYMWLGARFLEFEALGFLNEDHWFSRENSLSGVEGEGLHRLGYILRDVSKKEGGAMYADDTAGWDTRITLEDLKNEEMVTNHMKGEHKKLAEAIFKLTYQNKVVRVQRPTPRGTVMDIISRKDQRGSGQVGTYGLNTFTNMEAQLIRQMEGEGIFRSIQHLTATEEIAVQNWLARVGRERLSRMAISGDDCVVKPIDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEGYTDYMPSMKRFRREEEEAGVLW

SEQ ID NO: 3740 - protein, 3291 aa, Artificial Sequence
  derived and/or modified protein sequence (wt) from DENV-2__JX669478__SS-prME
TAGVIVMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKIVQPENLEYTIVITPHSGEEHAVGNDTGKHGKEIKITPQSSTTEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEITDLEKRHVLGRLITVNPIVTEKDSPVNIEAEPPFGDSYIIVGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAMVQADSGCIVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVALSFVTLITGNMSFRDLGRVMVMVGATMTDDIGMGVTYLALLAAFKVRPTFAAGLLLRKLTSKELMMATIGIALLSQSTLPETILELTDALALGMMALKIVRNMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVGKAELEDGAYRIKQRGIFGYSQIGAGVYKEGTFHTMWHVTRGAVLMHRGKRIEPSWADVKKDLISYGGGWKLEGEWKEGEEVQVLALEPGKNPRAVQTKPGIFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRKWCFDGIKNNQILEENVEVEIWTKEGERKKLKPRWLDARIYSDPLALKEFKEFAAGRKSLTLNLITEMGRLPTFMTQKARNALDNLAVLHTAEVGGKAYTHALSELPETLETLLLLTLLAAVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGFGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNVGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMETLQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVIPMVTQMAMTDTTPFGQQRVFKEKVDTRTQEPKEGTKKLMKITAEWLWKELGKEKTPRMCTREEFTRKVRSNAALGAVFTDENKWKSAREAVEDGRFWELVDRERNLHLEGKCETCVYNMMGKREKKLGEFGKAKGSRAIWYMWLGARFLEFEALGFLNEDHWFSRGNSLSGVEGEGLHRLGYILREVGKKEGGAMYADDTAGWDTRITLEDLKNEEMVTNHMKGEHKKLAEAIFKLTYQNKVVRVQRPTPRGTVMDIISRKDQRGSGQVGTYGLNTFTNMEAQLIRQMEGEGIFKSIQHLTATEEIAVQNWLARVGRERLSRMAISGDDCVVKPIDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEGYIDYMPSMKRFRREEEEAGVLW

SEQ ID NO: 3741 - protein, 3291 aa, Artificial Sequence
  derived and/or modified protein sequence (wt) from DENV-2__JX669480__SS-prME
TAGVIIMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFAIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVLPENLEYTIVITPHSGEEHAVGNDTGKHGEEIKITPQSSITEAELTGYGTVTMECSPRTGLDFNEMVLLQMEEKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEIMDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGVTMTDDIGMGVTYLALLAAFKVRPTFAAGLLLRKLTSKELMMATIGITLLSQSTIPETILELTDALALGMMVLKIVRNMEKYQLAVTIMAISCVPNAVILLNAWKVSCTILAAVSVSPLLLTSSQQKTDWIPLALTIKGLNPTAIFLTTLSRTSKKRSWPLNEAVMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVGKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGLFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFRAERVIDPRRCMKPVILTDGEERVILAGPMPVTHSSAAQRRGRVGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGIKNNQILEENVEVEIWTKEGERKKLKPRWLDARIYSDPLALKEFKEFAAGRKSLTLNLITEMGRLPTFMTQKTRDALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYTIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMETLQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMRITAEWLWKELGKKKTPRMCTREEFTRKVRSNAALGAIFTDENKWKSAREAVEDSRFWELVDRERNLHLEGKCETCVYNMMGKREKKLGEFGKAKGSRAIWYMWLGARFLEFEALGFLNEDHWFSRGNSLSGVEGEGLHRLGYILRDVSKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKSIQHLTVTEEIAVQNWLARVGRERLSRMAISGDDCVVKPLDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 3742 - protein, 3291 aa, Artificial Sequence
  derived and/or modified protein sequence (wt) from DENV-2__JX669483__SS-prME
TAGVIIMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFAIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVLPENLEYTIVITPHSGEEHAVGNDTGKHGEEIKITPQSSITEAELTGYGTVTMECSPRTGLDFNEMVLLQMEEKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIKVQYEGDGSPCKIPFEIMDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGVTMTDDIGMGVTYLALLAAFKVRPTFAAGLLLRKLTSKELMMATIGITLLSQSTIPETILELTDALALGMMVLKIVRNMEKYQLAVTIMAISCVPNAVILLNAWKVSCTILAAVSVSPLLLTSSQQKTDWIPLALTIKGLNPTAIFLTTLSRTSKKRSWPLNEAVMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVGKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGLFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFRAERVIDPRRCMKPVILTDGEERVILAGPMPVTHSSAAQRRGRVGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGIKNNQILEENVEVEIWTKEGERKKLKPRWLDARIYSDPLALKEFKEFAAGRKSLTLNLITEMGRLPTFMTQKTRDALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYTIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMETLQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMRITAEWLWKELGKKKTPRMCTREEFTRKVRSNAALGAIFTDENKWKSAREAVEDSRFWELVDRERNLHLEGKCETCVYNMMGKREKKLGEFGKAKGSRAIWYMWLGARYLEFEALGFLNEDHWFSRGNSLSGVEGEGLHRLGYILRDVSKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKSIQHLTVTEEIAVQNWLARVGRERLSRMAISGDDCVVKPLDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 3743 - protein, 3291 aa, Artificial Sequence
  derived and/or modified protein sequence (wt) from DENV-2__JX669484__SS-prME
TAGVIIMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFAIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVLPENLEYTIVITPHSGEEHAVGNDTGKHGKEIKITPQSSITEAELTGYGTVTMECSPRTGLDFNEMVLLQMEEKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEIMDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNGTWKMEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFKDLGRVMVMVGVAMTDDIGMGVTYLALLAAFKVRPTFAAGLLLRKLTSKELMMATIGITLLSQSTIPETILELTDALALGMMVLKIVRNMEKYQLAVTIMTISCVPNAVILLNAWKVSCTILAAVSVSPLLLTSSQQKTDWIPLALTIKGLNPTAIFLTTLSRTSKKRSWPLNEAVMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVGKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGLFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFRAERVIDPRRCMKPVILTDGEERVILAGPMPVTHSSAAQRRGRVGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGIKNNQILEENVEVEIWTKEGERKKLKPRWLDARIYSDPLALKEFKEFAAGRKSLTLNLITEMGRLPTFMTQKARDALDNLAVLHTAEAGGRAYNHALSELPETLETLLLLTLLATVTGGIFLFLMSGKGVGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMETLQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMRITAEWLWKELGKKKTPRMCTREEFTRKVRSNAALGAIFTDENKWKSAREAVEDSRFWELVDRERNLHLEGKCETCVYNMMGKREKKLGEFGKAKGSRAIWYMWLGARFLEFEALGFLNEDHWFSRGNSLSGVEGEGLHRLGYILRDVSKKEGGAMYADDTAGWDTRITLEDLKNEEMVINHMKGEHKKLAEAIFKLTYQNKVVRVQRPTPRGTVMDIISRRDQRGSGQVGTYGLNTFTNMEAQLIRQMEGEGIFKSIQHLTVTEEIAVQNWLARVGRERLSRMAISGDDCVVKPLDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 3744 - protein, 3291 aa, Artificial Sequence
  derived and/or modified protein sequence (wt) from DENV-2__JX669485__SS-prME
TAGVIIMLIPTAMAFHLTTRNGEPHMIVGKQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFAIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVLPENLEYTIVITPHSGEEHAVGNDTGKHGKEIKITPQSSITEAELTGYGTVTMECSPRTGLDFNEMVLLQMEEKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEIMDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNGTWKMEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVIVMVGVTMTDDIGMGVTYLALLAAFKVRPTFAAGLLLRKLTSKELMMATIGITLLSQSTIPETILELTDALALGMMVLKIVRNMEKYQLAVTIMAISCVPNAVILLNAWKVSCTILAVVSVSPLLLTSSQQKTDWIPLALTIKGLNPTAIFLTTLSRTSKKRSWPLNEAVMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVEKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGLFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRVGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGIKNNQILEENVEVEIWTKEGERKKLKPRWLDARIYSDPLALKEFKEFAAGRKSLTLNLITEMGRLPTFMTQKARDALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMETLQRKYGGALVRNPLSRNSTHEMYWVSNATGNIVSSVNMISRMLINRFTMKHKKATYELDVDLGSGTRNIGIESETPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMRITAEWLWKELGKKKTPRMCTREEFTRKVRSNAALGAIFTDENKWKSAREAVEDSRFWELVDRERNLHLEGKCETCVYNMMGKREKKLGEFGKAKGSRAIWYMWLGARFLEFEALGFLNEDHWFSRGNSLSGVEGEGLHRLGYILRDVSKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKSIQHLTVTEEIAVQNWLARVGRERLSRMAISGDDCVVKPLDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 3745 - protein, 3291 aa, Artificial Sequence
  derived and/or modified protein sequence (wt) from DENV-2__JX669486__SS-prME
TAGVIIMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFAIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVLPENLEYTIVITPHSGEEHAVGNDTGKHGEEIKITPQSSITEAELTGYGTVTMECSPRTGLDFNEMVLLQMEEKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEIMDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGVTMTDDIGMGVTYLALLAAFKVRPTFAAGLLLRKLTSKELMMATIGITLLSQSTTPETILELTDALALGMMVLKIVRNMEKYQLAVTIMTILCVPNAVILLNAWKVSCTILAVVSVSPLLLTSSQQKTDWIPLALTIKGLNPTAIFLTTLSRTSKKRSWPLNEAVMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVEKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGLFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFRAERVIDPRRCMKPVILTDGEERVILAGPMPVTHSSAAQRRGRVGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGIKNNQILEENVEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASVLLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVVDLEPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKRSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMETLQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMRITAEWLWKELGKKKTPRMCTREEFTRKVRSNAALGAIFTDENKWKSAREAVEDSRFWELVDRERNLHLEGKCETCVYNMMGKREKKLGEFGKAKGSRAIWYMWLGARFLEFEALGFLNEDHWFSRGNSLSGVEGEGLHRLGYILRDVSKKEGGAMYADDTAGWDTRITLEDLKNEEMVTNHMKGEHKKLAEAVFKLTYQNKVVRVQRPTPRGTVMDIISRRDQRGSGQVGTYGLNTFTNMEAQLIRQMEGEGIFKSIQHLTVTEEIAVQNWLARVGRERLSRMAISGDDCVVKPLDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 3746 - protein, 3291 aa, Artificial Sequence
  derived and/or modified protein sequence (wt) from DENV-2__JX669487__SS-prME
TAGVIIMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFAIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVLPENLEYTIMITPHSGEEHAVGNDTGKHGKEIKITPQSSITEAELTGYGTVTMECSPRTGLDFNEMVLLQMEEKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEIMDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGVTMTDDIGMGVTYLALLAAFKVRPTFAAGLLLRKLTSKELMMATIGIALLSQSTIPETILELTDALALGMMVLRIVRNMEKYQLAVTIMAISCVPNAVILLNAWKVSCTILAAVSVSPLLLTSSQQKTDWIPLALTIKGLNPTAIFLTTLSRTSKKRSWPLNEAVMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVEKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGLFKTNTGTIGAISLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFRAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGIKNNQILEENVEVEIWTKEGERKKLKPRWLDARIYSDPLALKEFKEFAAGRKSLTLNLITEMGRLPTFMTQKARDALDNLAVLHTAEAGGRAYKHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLAENWLNNNTQFCIKVLNPYMPSVIEKMETLQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMRITAEWLWKELGKKKTPRMCTREEFTRKVRSNAALGAIFTDENKWKSAREAVEDSRFWELVDRERNLHLEGKCETCVYNMMGKREKKLGEFGKAKGSRAIWYMWLGARFLEFEALGFLNEDHWFSRGNSLSGVEGEGLHRLGYILRDVSKKEGGAMYADDTAGWDTRITLEDLKNEEMVTNHMKGEHKKLAEAIFKLTYQNKVVRVQRPTPRGTVMDIISRKDQRGSGQVGTYGLNTFTNMEAQLIRQMEGEGIFKSIQHLTVTEEIAVQNWLARVGRERLSRMAISGDDCVVKPLDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 3747 - protein, 3291 aa, Artificial Sequence
  derived and/or modified protein sequence (wt) from DENV-2__JX669488__SS-prME
TAGVIIMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFAIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVLPENLEYTIVITPHSGEEHAVGNDTGKHGKEIKITPQSSITEAELTGYGTVTMECSPRTGLDFNEMVLLQMEEKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEIMDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAASFVTLITGNMSFRDLGRVMVMVGATMTDDIGMGVTYLALLAAFKVRPTFAAGLLLRKLTSKELMMATIGIALLSQSTIPETILELTDALALGMMVLRIVRNMEKYQLAVTIMAISCVPNAVILLNAWKVSCTILAAVSVSPLLLTSSQQKTDWIPLALTIKGLNPTAIFLTTLSRTSKKRSWPLNEAVMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVEKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGLFKTNTGTIGAISLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFRAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRRWCFDGIKNNQILEENVEVEIWTKEGERKKLKPRWLDARIYSDPLALKEFKEFAAGRKSLTLNLITEMGRLPTFMTQKARDALDNLAVLHTAEAGGRAYKHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTANTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLAENWLNNNTQFCIKVLNPYMPSVIEKMETLQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMRITAEWLWKELGKKKTPRMCTREEFTRKVRSNAALGAIFTDENKWKSAREAVEDSRFWELVDRERNLHLEGKCETCVYNMMGKREKKLGEFGKAKGSRAIWYMWLGARFLEFEALGFLNEDHWFSRGNSLSGVEGEGLHRLGYILRDVSKKEGGAMYADDTAGWDTRITLEDLKNEEMVTNHMEGEHKKLAEAIFKLTYQNKVVRVQRPTPRGTVMDIISRKDQRGSGQVGTYGLNTFTNMEAQLIRQMEGEGIFKSIQHLTVTEEIAVQNWLARVGRERLSRMAISGDDCVVKPLDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 3748 - protein, 3291 aa, Artificial Sequence
  derived and/or modified protein sequence (wt) from DENV-2__JX669479__SS-prME
TAGVIVMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKIVQSENLEYTIVITPHSGEEHAVGNDTGKHGKEIKITPQSSTTEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEITDLEKRHVLGRLITVNPIVTEKDSPVNIEAEPPFGDSYIIVGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAMVQADSGCIVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVALSFVTLITGNMSFRDLGRVMVMVGATMTDDIGMGVTYLALLAAFKVRPTFAAGLLLRKLTSKELMMATIGIALLSQSTLPETILELTDALALGMMALKIVRNMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVEKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGIFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRKWCFDGIKNNQILEENVEVEIWTKEGERKKLKPRWLDARIYSDPLALKEFKEFAAGRKSLTLNLITEMGRLPTFMTQKARNALDNLAVLHTAEVGGRAYTHALSELPETLETLLLLTLLAAVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGFGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNVGETLGEKWKSRLKALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMETLQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKEKTPRMCTREEFTRKVRSNAALGAVFTDENKWKSAREAVEDGRFWELVDRERNLHLEGKCETCVYNMMGKREKKLGEFGKAKGSRAIWYMWLGARFLEFEALGFLNEDHWFSRGNSLSGVEGEGLHRLGYILREVGKKEGGAMYADDTAGWDTRITLEDLKNEEMVTNHMKGEHKKLAEAIFKLTYQNKVVRVQRPTPRGTVMDIISRKDQRGSGQVGTYGLNTFTNMEAQLIRQMEGEGIFKSIQHLTATEEIAVQNWLARVGRERLSRMAISGDDCVVKPIDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEGYTDYMPSMKRFRREEEEAGVLW

SEQ ID NO: 3749 - protein, 3291 aa, Artificial Sequence
  derived and/or modified protein sequence (wt) from DENV-2__KF744403__SS-prME
TAGMIIMLIPTVMAFHLTTRNGEPHMIVSRQEKGKSLLFKTEDGVNMCTLMAMDLGELCEDTITYKCPLLRQNEPEDIDCWCNSTSTWVTYGTCTTTGEHRREKRSVALVPHVGMGLETRTETWMSSEGAWKHAQRIETWILRHPGFTLMAAILAYTIGTTNFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFVCKHSMVDRGWGNGCGLFGKGGIVTCAMFTCKKNMEGKIVQPENLEYTIVITPHSGEEHAVGNDTGKHGKEIKITPQSSITEAELTGYGTVTMECSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVVRVQYEGDGSPCKIPFEIMDLEKRHVLGRLITVNPIVTEKDSPVNIEAEPPFGDSYVIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGVVVQADSGCVVSWRNKELKCGSGIFITDNVHTWTEQYKFQPESPSKLASAIQKAHQEGICGIRSVTRLENLMWKQITPELNHILSENEVKLTIMTGDIKGIMHAGKRSLRPQPTELRYSWKTWGKAKILSTESHNQTFLIDGPETAECPNTNRAWNSLEVEDYGFGVFTTNIWLRLREKQDAFCDSKLMSAAIKDNRAVHADMGYWIESALNDTWKIEKASFIEVKSCHWPKSHTLWSNGVLESEMIIPKNFAGPVSQHNYRPGYHTQTAGPWHLGKLEMDFDFCKGTTVVVTEDCGNRGPSLRTTTASGKLITEWCCRSCTLPPLRYRGEDGCWYGMEIRPLKEKEENLVSSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMTTIGIVLLSQSTIPETILELTDALALGMMVLKIVRKMERYQLAVTIMAILCVPNAVILQNAWKVSCTILAVVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELEKAADVRWEDQAEISGSSPILSIIISEDGSMSIKNEEEEQTLTILIRTGLLVISGLFPVSIPITAAAWYLWEVKKQRAGVLWDVPSPPPVGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNAGTIGAVSLDFSPGTSGSPIIDKKGKVVGLYGNGVVTRNGSYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPIRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRRWCFDGIRNNQILEENVEVEIWTKEGERKKLKPRWLDARIYSDPLALKEFKEFAAGRKSLTLNLITEMGRLPTFMTQKARDALDNLAVLHTAEAGGRAYNHALSELPETLEILLLLTLLATVTGGIFLFLMSGRGIGKMTLGMCCIITASILLWYAQIQPHWIAASIILEFFLIVLLIPEPEKQRTPQDNQLTYVVIAILTVVAATMANEMGFLEKTKKDLGLGSITTQQPESNILDIDLRPASAWTLYAVATTFITPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLVLCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMITPEGKVVDLGCGRGGWSYYCGGLKNVREVKGLTKGGPGHEEPIPMSTYGWNLVRLQSGVDVFFTPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMKHKKATYEPDVDLGSGTRNIGIESEVPNLDIIGKRIEKIKQEHETSWHYDQDHPYKTWAYHGSYETKQTGSASSMVNGVVRLLTKPWDVIPMVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKSIQHLTATEEIAVQNWLARVGRERLSRMAISGDDCVVKPLDDRFASALTALNDMGKVRKDIQQWEPSKGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIQENPWMEDKTPVESWEEIPYLGKREDQWCGSLIGLTSRATWAKNIQTAINQVRSLIGNEEYTDYMPSMKRFRREEEEAGVLW

SEQ ID NO: 3750 - protein, 3291 aa, Artificial Sequence
  derived and/or modified protein sequence (wt) from DENV-2__KF744406__SS-prME
TAGMIIMLIPTVMAFHLTTRNGEPHMIVSRQEKGKSLLFKTEDGVNMCTLMAMDLGELCEDTITYKCPLLRQNEPEDIDCWCNSTSTWVTYGTCTTTGEHRREKRSVALVPHVGMGLETRTETWMSSEGAWKHAQRIETWILRHPGFTLMAAILAYTIGTTNFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFVCKHSMVDRGWGNGCGLFGKGGIVTCAMFTCKKNMEGKIVQPENLEYTIVITPHSGEEHAVGNDTGKHGKEIKITPQSSITEAELTGYGTVTMECSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVVRVQYEGDGSPCKIPFEIMDLEKRHVLGRLITVNPIVTEKDSPVNIEAEPPFGDSYVIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGVVVQADSGCVVSWRNKELKCGSGIFITDNVHTWTEQYKFQPESPSKLASAIQKAHQEGICGIRSVTRLENLMWKQITPELNHILSENEVKLTIMTGDIKGIMHAGKRSLRPQPTELRYSWKTWGKAKILSTESHNQTFLIDGPETAECPNTNRAWNSLEVEDYGFGVFTTNIWLRLREKQDAFCDSKLMSAAIKDNRAVHADMGYWIESALNDTWKIEKASFIEVKSCHWPKSHTLWSNGVLESEMIIPKNFAGPVSQHNYRPGYHTQTAGPWHLGKLEMDFDFCKGTTVVVTEDCGNRGPSLRTTTASGKLITEWCCRSCTLPPLRYRGEDGCWYGMEIRPLKEKEENLVSSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMTTIGIVLLSQSTIPETILELTDALALGMMVLKIVRKMERYQLAVTIMAILCVPNAVILQNAWKVSCTILAVVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELEKAADVRWEDQAEISGSSPILSIIISEDGSMSIKNEEEEQTLTILIRTGLLVISGLFPVSIPITAAAWYLWEVKKQRAGVLWDVPSPPPVGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNAGTIGAVSLDFSPGTSGSPIIDKKGKVVGLYGNGVVTRNGSYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPIRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRRWCFDGIRNNQILEENVEVEIWTKEGERKKLKPRWLDARIYSDPLALKEFKEFAAGRKSLTLNLITEMGRLPTFMTQKARDALDNLAVLHTAEAGGRAYNHALSELPETLEISLLLTLLATVTGGIFLFLMSGRGIGKMTLGMCCIITASILLWYAQIQPHWIAASIILEFFLIVLLIPEPEKQRTPQDNQLTYVVIAILTVVAATMANEMGFLEKTKKDLGLGSITTQQPESNILDIDLRPASAWTLYAVATTFITPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLVLCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMITPEGKVVDLGCGRGGWSYYCGGLKNVREVKGLTKGGPGHEEPIPMSTYGWNLVRLQSGVDVFFTPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMKHKKATYEPDVDLGSGTRNIGIESEVPNLDIIGKRIEKIKQEHETSWHYDQDHPYKTWAYHGSYETKQTGSASSMVNGVVRLLTKPWDVIPMVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKSIQHLTATEEIAVQNWLARVGRERLSRMAISGDDCVVKPLDDRFASALTALNDMGKVRKDIQQWEPSKGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIQENPWMEDKTPVESWEEIPYLGKREDQWCGSLIGLTSRATWAKNIQTAINQVRSLIGNEEYTDYMPSMKRFRREEEEAGVLW

SEQ ID NO: 3751 - protein, 3291 aa, Artificial Sequence
  derived and/or modified protein sequence (wt) from DENV-2__KF744404__SS-prME
TAGMIIMLIPTVMAFHLTTRNGEPHMIVSRQEKGKSLLFKTEDGVNMCTLMAMDLGELCEDTITYKCPLLRQNEPEDIDCWCNSTSTWVTYGTCTTTGEHRREKRSVALVPHVGMGLETRTETWMSSEGAWKHAQRIETWILRHPGFTLMAAILAYTIGTTNFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFVCKHSMVDRGWGNGCGLFGKGGIVTCAMFTCKKNMEGKIVQPENLEYTIVITPHSGEEHAVGNDTGKHGKEIKITPQSSITEAELTGYGTVTMECSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVVRVQYEGDGSPCKIPFEIMDLEKRHVLGRLITVNPIVTEKDSPVNIEAEPPFGDSYVIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGVVVQADSGCVVSWRNKELKCGSGIFITDNVHTWTEQYKFQPESPSKLASAIQKAHQEGICGIRSVTRLENLMWKQITPELNHILSENEVKLTIMTGDIKGIMHAGKRSLRPQPTELRYSWKTWGKAKILSTESHNQTFLIDGPETAECPNTNRAWNSLEVEDYGFGVFTTNIWLRLREKQDAFCDSKLMSAAIKDNRAVHADMGYWIESALNDTWKIEKASFIEVKSCHWPKSHTLWSNGVLESEMIIPKNFAGPVSQHNYRPGYHTQTAGPWHLGKLEMDFDFCKGTTVVVTEDCGNRGPSLRTTTASGKLITEWCCRSCTLPPLRYRGEDGCWYGMEIRPLKEKEENLVSSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMTTIGIVLLSQSTIPETILELTDALALGMMVLKIVRKMERYQLAVTIMAILCVPNAVILQNAWKVSCTILAVVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELEKAADVRWEDQAEISGSSPILSIIISEDGSMSIKNEEEEQTLTILIRTGLLVISGLFPVSIPITAAAWYLWEVKKQRAGVLWDVPSPPPVGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNAGTIGAVSLDFSPGTSGSPIIDKKGKVVGLYGNGVVTRNGSYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPIRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRRWCFDGIRNNQILEENVEVEIWTKEGERKKLKPRWLDARIYSDPLALKEFKEFAAGRKSLTLNLITEMGRLPTFMTQKARDALDNLAVLHTAEAGGRAYNHALSELPETLQISLLLTLLATVTGGIFLFLMSGRGIGKMTLGMCCIITASILLWYAQIQPHWIAASIILEFFLIVLLIPEPEKQRTPQDNQLTYVVIAILTVVAATMANEMGFLEKTKKDLGLGSITTQQPESNILDIDLRPASAWTLYAVATTFITPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLVLCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMITPEGKVVDLGCGRGGWSYYCGGLKNVREVKGLTKGGPGHEEPIPMSTYGWNLVRLQSGVDVFFTPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMKHKKATYEPDVDLGSGTRNIGIESEVPNLDIIGKRIEKIKQEHETSWHYDQDHPYKTWAYHGSYETKQTGSASSMVNGVVRLLTKPWDVIPMVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKSIQHLTATEEIAVQNWLARVGRERLSRMAISGDDCVVKPLDDRFASALTALNDMGKVRKDIQQWEPSKGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIQENPWMEDKTPVESWEEIPYLGKREDQWCGSLIGLTSRATWAKNIQTAINQVRSLIGNEEYTDYMPSMKRFRREEEEAGVLW

SEQ ID NO: 3752 - protein, 3291 aa, Artificial Sequence
  derived and/or modified protein sequence (wt) from DENV-2__KF744407__SS-prME
TAGMIIMLIPTVMAFHLTTRNGEPHMIVSRQEKGKSLLFKTEDGVNMCTLMAMDLGELCEDTITYKCPLLRQNEPEDIDCWCNSTSTWVTYGTCTTTGEHRREKRSVALVPHVGMGLETRTETWMSSEGAWKHAQRIETWILRHPGFTLMAAILAYTIGTTNFQRALIFILLTAVAPSMTMRCIGISNRDFVEGVSGGSWVDIVLEHGSCVTTMAKNKPTLDFELIKTEAKHPATLRKYCIEAKLTNTTTASRCPTQGEPSLNEEQDKRFVCKHSMVDRGWGNGCGLFGKGGIVTCAMFTCKKNMEGKVVQPENLEYTIVITPHSGEEHAVGNDTGKHGKEIKITPQSSITEAELTGYGTVTMECSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVVRVQYEGDGSPCKIPFEIMDLEKRHVLGRLITVNPIVTEKDSPVNIEAEPPFGDSYVIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGVMVQADSGCVASWKNKELKCGSGIFITDNVHTWTEQYKFQPESPSKLASAIQKAHQEGICGIRSVTRLENLMWKQITPELNHILSENEVKLTIMTGDIKGIMHAGKRSLRPQPTELRYSWKTWGKAKILSTESHNQTFLIDGPETAECPNTNRAWNSLEVEDYGFGVFTTNIWLRLREKQDAFCDSKLMSAAIKDNRAVHADMGYWIESALNDTWKIEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVSSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMTTIGIVLLSQSTIPETILELTDALALGMMVLKIVRNMEKYQLAVTIMAILCVPNAVILQNAWKVSCTILAVVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELEKAADVRWEEQAEISGSSPILSIIISEDGSMSIKNEEEEQTLTILIRTGLLVISGLFPVSIPITAAAWYLWEVKKQRAGVLWDVPSPPPVGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNAGTIGAVSLDFSPGTSGSPIIDKKGKVVGLYGNGVVTRNGSYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPIRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRRWCFDGIRNNQILEENVEVEIWTKEGERKKLKPRWLDARIYSDPLALKEFKEFAAGRKSLTLNLITEMGRLPTFMTQKARDALDNLAVLHTAEAGGRAYNHALSELPETLETLLLLTLLATVTGGIFLFLMSGKGIGKMTLGMCCIITASVLLWYAQIQPHWIAASIILEFFLIVLLIPEPEKQRTPQDNQLTYVVIAILTVVAATMANEMGFLEKTKKDFGLGSIATQQPESNILDIDLRPASAWTLYAVATTFITPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLVLCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMITPEGKVVDLGCGRGGWSYYCGGLKNVREVKGLTKGGPGHEEPIPMSTYGWNLVRLQSGVDVFFTPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMKHKKATYEPDVDLGSGTRNIGIESEVPNLDIIGKRIEKIKQEHETSWHYDQDHPYKTWAYHGSYETKQTGSASSMVNGVVRLLTKPWDVIPMVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKSIQHLTATEEIAVQNWLTRVGRERLSRMAISGDDCVVKPLDDRFASALTALNDMGKVRKDIQQWEPSKGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIQENPWMEDKTPVESWEEIPYLGKREDQWCGSLIGLTSRATWAKNIQTAINQVRSLIGNEEYTDYMPSMKRFRREEEEAGVLW

SEQ ID NO: 3753 - protein, 3291 aa, Artificial Sequence
  derived and/or modified protein sequence (wt) from DENV-2__KF744399__SS-prME
TAGMIIMLIPTVMAFHLTTRNGEPHMIVSRQEKGKSLLFKTEDGVNMCTLMAMDLGELCEDTITYKCPLLRQNEPEDIDCWCNSTSTWVTYGTCTTTGEHRREKRSVALVPHVGMGLETRTETWMSSEGAWKHAQRIETWILRHPGFTLMAAILAYTIGTTNFQRALIFILLTAVAPSMTMRCIGISNRDFVEGVSGGSWVDIVLEHGSCVTTMAKNKPTLDFELIKTEAKHPATLRKYCIEAKLTNTTTESRCPTQGEPSLNEEQDKRFVCKHSMVDRGWGNGCGLFGKGGIVTCAMFTCKKNMEGKIVQPENLEYTIVITPHSGEENAVGNDTGKHGKEIKVTPQSSITEAELTGYGTVTMECSPRTGLGFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVVRVQYEGDGSPCKIPFEIMDLEKRHVLGRLITVNPIVTEKDSPVNIEAEPPFGDSYVIIGVEPGQLKLSWFKKGSSIGQMFETTMRGAKRMAILGDTAWDFGSLGGVFTSIGKALHQVFGAIYGAAFSGVSWTMKILIGVVITWIGMNSRSTSLSVSLVLVGVVTLYLGVMVQADSGCVVSWKNKELKCGSGIFITDNVHTWTEQYKFQPESPSKLASAIQKAHQEGICGIRSVTRLENLMWKQITPELNHILSENEVKLTIMTGDIKGIMHAGKRSLRPQPTELRYSWKAWGKAKILSTELHNQTFLIDGPETAECPNTNRAWNSLEVEDYGFGVFTTNIWLKLREKQDAFCDSKLMSAAIKDNRAVHADMGYWIESALNDTWKIEKASFIEVKSCHWPKSHTLWSNGVLESEMIIPKNFAGPVSQHNYRPGYHTQTAGPWHLGKLEMDFDFCKGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMTTIGIVLLSQSTIPETILELTDALALGMMVLKIVRKMERYQLAVTIMAILCVPNAVILQNAWKVSCTILAVVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELEKAADVRWEEQAEISGSSPILSIIISEDGSMSIKNEEEEQTLTILIRTGLLVISGLFPVSIPITAAAWYLWEVKKQRAGVLWDVPSPPPVGKAELEDGAYRIKQKGILGYSQIGAGVYKEGTFHTMWHVTRGAVLMHKGKRLEPSWADVKKDLISYGGGWKLEGEWKEGEEVQVLALEPGKNPRAVQTKPGLFKTNTGTIGAVSLDFSPGTSGSPIIDKKGKVVGLYGNGVVTRNGSYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPIRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRRWCFDGIRNNQILEENVEVEIWTKEGERKKLKPRWLDARIYSDPLALKEFKEFAAGRKSLTLNLITEMGRLPTFMTQKARDALDNLAVLHTAEAGGRAYNHALSELPETLETLLLLTLLATVTGGIFLFLMSGKGIGKMTLGMCCIITASVLLWYAQIQPHWIAASIILEFFLIVLLIPEPEKQRTPQDNQLTYVVIAILTVVAATMANEMGFLEKTKKDFGLGSIATQQPESNILDIDLRPASAWTLYAVATTFITPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLVLCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESEIPNLDIIGKRIEKIKQEHETSWHYDQDHPYKTWAYHGSYETKQTGSASSMVNGVVRLLTKPWDVIPMVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILREVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKSIQHLTATEENAVQNWLARVGRERLSRMAISGDDCVVKPLDDRFASALTALNDMGKVRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKNEWMTTEDMLTVWNRVWIQENPWMEDKTPVESWEEIPYLGKREDQWCGSLIGLTSRATWAKNIQTAINQVRSLIGNEEYTDYMPSMKRFRREEEEAGVLW

SEQ ID NO: 3754 - protein, 3291 aa, Artificial Sequence
  derived and/or modified protein sequence (wt) from DENV-2__JX286516__SS-prME
TAGVIVMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKIVQPENLEYTIVITPHSGEEHAVGNDTGKHGKEIKITPQSSTTEAELTGYGIVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEITDLEKRHVLGRLITVNPIVTEKDSPVNIEAEPPFGDSYIIVGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAMVQADSGCIVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVALSFVTLITGNMSFRDLGRVMVMVGATMTDDIGMGVTYLALLAAFKVRPTFAAGLLLRKLTSKELMMATIGIALLSQSTLPETILELTDALALGMMALKIVRNMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVGKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGIFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRKWCFDGIKNNQILEENVEVEIWTKEGERKKLKPRWLDARIYSDPLALKGFKEFAAGRKSLTLNLITEMGRLPTFMTQKARNALDNLAVLHTAEVGGKAYTHALSELPETLETLLLLTLLAAVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGFGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNVGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMETLQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKEKTPRMCTREEFTRKVRSNAALGAVFTDENKWKSAREAVEDGRFWELVDRERNLHLEGKCETCVYNMMGKREKKLGEFGKAKGSRAIWYMWLGARFLEFEALGFLNEDHWFSRGNSLSGVEGEGLHRLGYILREVGKKEGGAMYADDTAGWDTRITLEDLKNEEMVTNHMKGEHKKLAEAIFKLTYQNKVVRVQRPTPRGTVMDIISRKDQRGSGQVGTYGLNTFTNMEAQLIRQMEGEGIFKSIQHLTATEEIAVQNWLARVGRERLSRMAISGDDCVVKPIDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEGYTDYMPSMKRFRREEEEAGVLW

SEQ ID NO: 3755 - protein, 3291 aa, Artificial Sequence
  derived and/or modified protein sequence (wt) from DENV-2__JX286518__SS-prME
TAGVIVMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKIVQPENLEYTIVITPHSGEEHAVGNDTGKHGKEIKITPQSSTTEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEITDLEKRHVLGRLITVNPIVTEKDSPVNIEAEPPFGDSYIIVGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAMVQADSGCIVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVALSFVTLITGNMSFRDLGRVMVMVGATMTDDIGMGVTYLALLAAFKVRPTFAAGLLLRKLTSKELMMATIGIALLSQSTLPETILELTDALALGMMALKIVRNMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVGKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGIFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRKWCFDGIKNNQILEENVEVEIWTKEGERKKLKPRWLDARIYSDPLALKEFKEFAAGRKSLTLNLITEMGRLPTFMTQKARNALDNLAVLHTAEVGGKAYTHALSELPETLETLLLLTLLAAVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGFGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNVGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMETLQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKEKTPRMCTREEFTRKVRSNAALGAVFTDENKWKSAREAVEDGRFWELVDRERNLHLEGKCETCVYNMMGKREKKLGEFGKAKGSRAIWYMWLGARFLEFEALGFLNEDHWFSRGNSLSGVEGEGLHRLGYILREVGKKEGGAMYADDTAGWDTRITLEDLKNEEMVTNHMKGEHKKLAEAIFKLTYQNKVVRVQRPTPRGTVMDIISRKDQRGSGQVGTYGLNTFTNMEAQLIRQMEGEGIFKSIQHLTATEEIAVQNWLARVGRERLSRMAISGDDCVVKPIDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEGYTDYMPSMKRFRREEEEAGVLW

SEQ ID NO: 3756 - protein, 3291 aa, Artificial Sequence
  derived and/or modified protein sequence (wt) from DENV-2__JX286519__SS-prME
TAGVIVMLIPTAMAFHLTTRNGEPHMIVGRQEKGKSLLFKTEDGINMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKIVQPENLEYTIVITPHSGEEHAVGNDTGKHGKEIKITPQSSTTEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEITDLEKRHVLGRLITVNPIVTEKDSPVNIEAEPPFGDSYIIVGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAMVQADSGCIVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVALSFVTLITGNMSFRDLGRVMVMVGATMTDDIGMGVTYLALLAAFKVRPTFAAGLLLRKLTSKELMMATIGIALLSQSTLPETILELTDALALGMMALKIVRNMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVGKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGIFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIVPSMFEPEREKVDAIDGEYRLRGEARKTFVDLMRRGDLPVWLAYKVAAEGINYADRKWCFDGIKNNQILEENVEVEIWTKEGERKKLKPRWLDARIYSDPLALKEFKEFAAGRKSLTLNLITEMGRLPTFMTQKARSALDNLAVLHTAEVGGKAYTHALSELPETLETLLLLTLLAAVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGFGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNVGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMETLQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKEKTPRMCTREEFTRKVRSNAALGAVFTDENKWKSAREAVEDGRFWELVDRERNLHLEGKCETCVYNMMGKREKKLGEFGKAKGSRAIWYMWLGARFLEFEALGFLNEDHWFSRGNSLSGVEGEGLHRLGYILREVGKKEGGAMYADDTAGWDTRITLEDLKNEEMVTNHMKGEHKKLAEAIFKLTYQNKVVRVQRPTPRGTVMDIISRKDQRGSGQVGTYGLNTFTNMEAQLIRQMEGEGIFKSIQHLTATEEIAVQNWLARVGRERLSRMAISGDDCVVKPIDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEGYTDYMPSMKRFRREEEEAGVLW

SEQ ID NO: 3757 - protein, 3291 aa, Artificial Sequence
  derived and/or modified protein sequence (wt) from DENV-2__KP188549__SS-prME
TAGVIVMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKIVQPENLEYTIVITPHSGEEHAVGNDTGKHGKEIKITPQSSTTEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEITDLEKRHVLGRLITVNPIVTEKDSPVNIEAEPPFGDSYIIVGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAMVQADSGCIVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMVIPKNFAGPVSQHNYRPGYHTQTAGPWHLGKLEMDFDFCEGTTVVVTEDCEKRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVALSFVTLITGNMSFRDLGRVMVMVGATMTDDIGMGVTYLALLAAFKVRPTFAAGLLLRKLTSKELMMATIGIALLSQSTLPETILELTDALALGMMALKIVRNMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVGKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGIFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRKWCFDGIKNNQILEENVEVEIWTKEGERKKLKPRWLDARIYSDPLALKEFKEFAAGRKSLTLNLITEMGRLPTFMTQKARNALDNLAVLHTAEVGGKAYTHALSELPETLETLLLLTLLAAVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGFGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNVGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMETLQRKYGGALVRNPLSRNSTHEMYWVSNATGNIVSSVNMISRMLINRFTMKHKKATYEPDVDLGSGTRNIGIESETPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKEKTPRMCTREEFTRKVRSNAALGAVFTDENKWKSAREAVEDGRFWELVDRERNLHLEGKCETCVYNMMGKREKKLGEFGKAKGSRAIWYMWLGARFLEFEALGFLNEDHWFSRGNSLSGVEGEGLHRLGYILREVGKKEGGAMYADDTAGWDTRITLEDLKNEEMVTNHMKGEHKKLAEAIFKLTYQNKVVRVQRPTPRGTVMDIISRKDQRGSGQVGTYGLNTFTNMEAQLIRQMEGEGIFKSIQHLTATEETAVQNWLARVGRERLSRMAISGDDCVVKPIDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEGYTDYMPSMKRFRREEEEAGVLW

SEQ ID NO: 3758 - protein, 3291 aa, Artificial Sequence
  derived and/or modified protein sequence (wt) from DENV-2__KP188550__SS-prME
TAGVIVMLIPTVMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKIVQPENLEYTIVITPHSGEEHAVGNDTGKHGKEIKITPQSSTTEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEITDLEKRHVLGRLITVNPIVTEKDSPVNIEAEPPFGDSYIIVGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAMVQADSGCIVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVALSFVTLITGNMSFRDLGRVMVMVGATMTDDIGMGVTYLALLAAFKVRPTFAAGLLLRKLTSKELMMATIGIALLSQSTLPETILELTDALALGMMALKIVRNMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVGKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGIFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRKWCFDGIKNNQILEENVEVEIWTKEGERKKLKPRWLDARIYSDPLALKEFKEFAAGRKSLTLNLITEMGRLPTFMTQKARNALDNLAVLHTAEVGGRAHTHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGFGTITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNVGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMETLQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAKWLWKELGKEKTPRMCTREEFTRKVRSNAALGAIFTDENKWKSAREAVEDGRFWELVDRERNLHLEGKCETCVYNMMGKREKKLGEFGKAKGSRAIWYMWLGARFLEFEALGFLNEDHWFSRGNSLSGVEGEGLHRLGYILREVGKKEGGAMYADDTAGWDTRITLEDLKNEEMVTNHMKGEHKKLAEAIFKLTYQNKVVRVQRPTPRGTVMDIISRKDQRGSGQVGTYGLNTFTNMEAQLIRQMEGEGIFKNIQHLTATEEIAVQNWLARVGRERLSRMAISGDDCVVKPIDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEGYTDYMPSMKRFRREEEEAGVLW

SEQ ID NO: 3759 - protein, 3291 aa, Artificial Sequence
  derived and/or modified protein sequence (wt) from DENV-2__KP188553__SS-prME
TAGVIVMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKIVQPENLEYTIVITPHSGEEHAVGNDTGKHGKEIKITPQSSTTEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEITDLEKRHVLGRLITVNPIVTEKDSPVNIEAEPPFGDSYIIVGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAMVQADSGCIVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMVIPKNFAGPVSQHNYRPGYHTQTAGPWHLGKLEMDFDFCEGTTVVVTEDCEKRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVALSFVTLITGNMSFRDLGRVMVMVGATMTDDIGMGVTYLALLAAFKVRPTFAAGLLLRKLTSKELMMATIGIALLSQSTLPETILELTDALALGMMALKIVRNMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVGKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGIFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIPYSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRKWCFDGIKNNQILEENVEVEIWTKEGERKKLKPRWLDARIYSDPLALKEFKEFAAGRKSLTLNLITEMGRLPTFMTQKARNALDNLAVLHTAEVGGKAYTHALSELPETLETLLLLTLLAAVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGFGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNVGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMETLQRKYGGALVRNPLSRNSTHEMYWVSNATGNIVSSVNMISRMLINRFTMKHKKATYEPDVDLGSGTRNIGIESETPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKEKTPRMCTREEFTRKVRSNAALGAVFTDENKWKSAREAVEDGRFWELVDRERNLHLEGKCETCVYNMMGKREKKLGEFGKAKGSRAIWYMWLGARFLEFEALGFLNEDHWFSRGNSLSGVEGEGLHRLGYILREVGKKEGGAMYADDTAGWDTRITLEDLKNEEMVTNHMKGEHKKLAEAIFKLTYQNKVVRVQRPTPRGTVMDIISRKDQRGSGQVGTYGLNTFTNMEAQLIRQMEGEGIFKSIQHLTATEETAVQNWLARVGRERLSRMAISGDDCVVKPIDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEGYTDYMPSMKRFRREEEEAGVLW

SEQ ID NO: 3760 - protein, 3291 aa, Artificial Sequence
  derived and/or modified protein sequence (wt) from DENV-2__KP188556__SS-prME
TAGVIVMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKIVQPENLEYTIVITPHSGEEHAVGNDTGKHGKEIKITPQSSTTEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEITDLEKRHVLGRLITVNPIVTEKDSPVNIEAEPPFGDSYIIVGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAMVQADSGCIVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMVIPKNFAGPVSQHNYRPGYHTQTAGPWHLGKLEMDFDFCEGTTVVVTEDCEKRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVALSFVTLITGNMSFRDLGRVMVMVGATMTDDIGMGVTYLALLAAFKVRPTFAAGLLLRKLTSKELMMATIGIALLSQSTLPETILELTDALALGMMALKIVRNMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVGKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGIFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRKWCFDGIKNNQILEENVEVEIWTKEGERKKLKPRWLDARIYSDPLALKEFKEFAAGRKSLTLNLITEMGRLPTFMTQKARNALDNLAVLHTAEVGGKAYTHALSELPETLETLLLLTLLAAVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGFGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPHDPKFEKQLGQVMLLILCVTQVLMMRTTWALCEALTLATGPISTLWEGNPGRFWNTTIAVSMANIFRGSYLAGAGLLFSIMKNTTNTRRGTGNVGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMETLQRKYGGALVRNPLSRNSTHEMYWVSNATGNIVSSVNMISRMLINRFTMKHKKATYEPDVDLGSGTRNIGIESETPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKEKTPRMCTREEFTRKVRSNAALGAVFTDENKWKSAREAVEDGRFWELVDRERNLHLEGKCETCVYNMMGKREKKLGEFGKAKGSRAIWYMWLGARFLEFEALGFLNEDHWFSRGNSLSGVEGEGLHRLGYILREVGKKEGGAMYADDTAGWDTRITLEDLKNEEMVTNHMKGEHKKLAEAIFKLTYQNKVVRVQRPTPRGTVMDIISRKDQRGSGQVGTYGLNTFTNMEAQLIRQMEGEGIFKSIQHLTATEETAVQNWLARVGRERLSRMAISGDDCVVKPIDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEGYTDYMPSMKRFRREEEEAGVLW

SEQ ID NO: 3761 - protein, 3291 aa, Artificial Sequence
  derived and/or modified protein sequence (wt) from DENV-2__GU369819__SS-prME
TAGVIVMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVQPENLEYTIVITPHSGEEHAVGNDTGKHGKEIKITPQSSITEAELTGYGTVTMECSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEITDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAMVRADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDLCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRIGTKHAILLVAVSFVTLITGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVGKAELEDGAYRIKQKGILGYSQIGAGVYKEGTFHTMWHVTRGAVLMHRGKRIEPSWADVKKDLISYGGGWKLEGEWKEGEEVQVLALEPGKNPRAVQTKPGIFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIKTEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRKWCFDGIKNNQILEENIEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGRGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQVYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMEALQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVLPMVTQMAMTDTTPFGQQRVFKEKVDTRTQEPKEGTKKLMKITAEWLWKELGKKKTPRMCTREEFTRKVRSNAALGAIFTDENKWKSAREAVEDGRFWELVDRERNLHLEGKCETCVYNMMGKREKKLGEFGKAKGSRAIWYMWLGARFLEFEALGFLNEDHWFSRGNSLSGVEGEGLHRLGYILRDVGKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKSIQHLTATEEIAVQNWLARVGRERLSRMAISGDDCVVKPIDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPPHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 3762 - protein, 3291 aa, Artificial Sequence
  derived and/or modified protein sequence (wt) from DENV-2__JX649147__SS-prME
TAGVIIMLIPTAMAFHLTTRNGEPHMIVGRQEKGKSLLFKTEDGVNMCTLMAIDLGELCEDTITYKCPLLRQSEPEDIDCWCNSTSTWVTYGTCTTTGEHRREKRSVALVPHVGMGLETRTETWMSSEGAWKHAQRIETWILRHPGFTIMAAILAYTIGTTHFQKALIFILLTAVAPSMTMRCIGISNRDFVEGVSGGSWVDIVLEHGSCVTTMAKNKPTLDFELIKTEAKEPATLRKYCIEAKLTNTTTESRCPTQGEPSLNEEQDKRFVCKHSMVDRGWGNGCGLFGKGGIVTCAMFTCKKNMEGKIVQPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEIMDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVITLYLGAMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNKNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKSFAGPVSQHNYRPGYYTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLKKLTSKELMMATIGIALLSQSTIPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERATDVKWEDQAEISGSSPILSITISEDGSMSIKNEEEEQTLTILIRTGLLVISGLFPMSIPITAAAWYLWEVKKQRAGVLWDVPSPPPVGKAELEDGAYRIKQKGILGYSQIGAGVYKEGTFHTMWHVTRGAVLMHRGKRIEPSWADVKKDLISYGGGWKLEGEWKEGEEVQVLALEPGKNPRAVQTKPGLFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGVKNNQILEENVEVEIWTKEGERKKLKPRWLDARIYSDPLALKEFKEFAAGRKSLTLNLITEMGRLPTFMTQKARDALDNLAVLHTAEAGGRAYNHALSELPETLETLLLLTLLATVTGGIFLFLMSGKGVGKMTLGMCCIITASILLWYAQIQPHWIAASIILEFFLIVLLIPEPEKQRTPQDNQLTYVVIAILTVVAATMANEMGFLEKTKKDLGLGSIATQEPESNILDIDLRPASAWTLYAVATTFVTPMLRHSIENSSVNVSLTAIANQATVLMGLGKGWPLSKMDIGVPLLAIGCYSQVNPITLTAALLLLIAHYAIIGPGLQAKATREAQKRAAAGIMKNPTVDGITVIDLDPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLSLVENWLNNDTQFCIKVLNPYMPSVIEKMETLQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGIFKSIQHLTVTEEIAVQDWLARVGRERLSRMAISGDDCVVKPLDDRFASALTALNDMGKVRKDIQQWEPSRGWNDWTQVPFCSHHFHELIMKDGRVLVVPCRNQDELIGRARISQGAGWSLKETACLGKSYAQMWSLMYFHRRDLRLAANAICSAVPSHWVPTSRTTWSIHAKHEWMTTEDMLTVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 3763 - protein, 3291 aa, Artificial Sequence
  derived and/or modified protein sequence (wt) from DENV-2__KF704356__SS-prME
TAGMIIMLIPTVMAFHLTTRNGEPHMIVSRQEKGKSLLFNTGDGVHMCTLMAMHLGELCEDTITYKCPLLRQNEPEDIDCWCNSTSTWVTYGTCTTTGEHRREKRSVALVPHVGMGLETRTETWMSSEGAWKHAQRIETWILRHPGFTIMAAILAYTIGTTHFQRALIFILLTAVAPSMTMRCIGISNRDFVEGVSGGSWVDIVLEHGSCVTTMAKNKPTLDLELIKTEAKQPATLRKYCIEAKLTNTTTESRCPTQGEPSLNEEQDKRFVCKHSMVDRGWGNGCGLFGKGSIVTCAMFTCKKIMKGKVVQPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNVLFTGHLKCRLRMDKLQLKGMSYSMCTGKFKVVKEIAETQHGTIVIRVQYEGDGSPCKIPFEIMDLEKRHVLGRLITVNPIVTGKDSPVNIEAEPPFGDSYIIIGVEPGQLKLNWFKKGSSIGQMFATTMRGAKRMAILGDTAWDFGSLGGVFTSIGKALHQVFGAIYGAAFSGVSWTMKILIGVIITWIGMNSRSTSLSVSLVLVGVVTLYLGVMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLREEQDVFCDSKLMSAAIKDNRAVHADMGYWIESALNDTWKIEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMTTIGIVLLSQSTIPETILELTDALALGMMVLKMVRKMEKYQLAVTIMAILCVPNAVILQNTWKVSCTILAVVSVSPLFLTSSQQKADWIPLALTIKGLNPTAIFLTTLSRTNKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGLFPVSIPITAAAWYLWEVKKQRAGVLWDVPSPPPVGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNAGTIGAVSLDFSPGTSGSPIIDRKGKVVGLYGNGVVTRSGAYVSAIAQTEKSIEDNPEIEDDIFRKRKLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWSSGHEWVTDFKGKTVWFVPSIRAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGIKNNQILEENVEVEIWTKEGERKKLKPRWLDARIYSDPLALKEFKEFAAGRKSLTLNLITEMGRLPTFMTQKARDALDNLAVLHTAEAGGRAYNHALSELPETLETLLLLTLLATVTGGIFLFLMSGRGIGKMTLGMCCIITASILLWYAQIQPHWIAASIILEFFLIVLLIPEPEKQRTPQDNQLTYVVIAILTVVAATMANEMGFLEKTKKDLGLGSITTQQPESNILDIDLRPASAWTLYAVATTFVTPMLRHSIENSSVNVSLTAIANQATVLMGLGKGWPLSKMDIGVPLLAIGCYSQVNPITLTAALFLLVAHYAIIGPGLQAKATREAQKRAAAGIMKNPTVDGITVIDLDPIPYDPKFEKQLGQVMLLVLCVTQVLMMRTTWALCEALTLATGPISTLWEGNPGRFWNTTIAVSMANIFRGSYLAGAGLLFSIMKNTTNTRRGTGNMGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATFEPDVDLGSGTRNIGIESEIPNLDIIGKRIEKIKQEYETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKNIQHLTVTEEIAVQNWLARVGRERLSRMAISGDDCVVKPLDDRFASALTALNDMGKVRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIQENPWMEDKTPVESWEEIPYLGKREDQWCGSLIGLTSRATWAKNIQTAINQVRSLIGNEEYTDYMPSMKRFRREEEEAGVLW

SEQ ID NO: 3764 - protein, 3291 aa, Artificial Sequence
  derived and/or modified protein sequence (wt) from DENV-2__KF704355__SS-prME
TAGMIIMLIPTVMAFHLTTRNGEPHMIVSRQEKGKSLLFKTGDGVNMCTLMAMDLGELCEDTITYKCPFLRQNEPEDIDCWCNSTSTWVTYGTCTTTGEHRREKRSVALVPHVGMGLETRTETWMSSEGAWKHAQRIETWILRHPGFTIMAAILAYTIGTTHFQRALIFILLTAVAPSMTMRCIGISNRDFVEGVSGGSWVDIVLEHGSCVTTMAKNKPTLDLELIKTEAKQPATLRKYCIEAKLTNTTTESRCPTQGEPSLNEEQDKRFVCKHSMVDRGWGNGCGLFGKGSIVTCAMFTCKKIMKGKVVQPENLEYTIVITPHSGEEHAVGNDTGKYGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNVLFTGHLKCRLRMDKLQLKGMSYSMCTGKFKVVKEIAETQHGTIVIRVQYEGDGSPCKIPFEIMDLEKRHVLGRLITVNPIVTGKDSPVNIEAEPPFGDSYIIIGVEPGQLKLNWFKKGSSIGQMFGTTMRGAKRMAILGDTAWDFGSLGGVFTSIGKALHQVFGAIYGAAFSGVSWTMKILTGVIITWIGMNSRSTSLSVSLVLVGVVTLYLGVMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKIEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMTTIGIVLLSQSTIPETILELTDALALGMMVLKMVRKMEKYQLAVTIMAILCVPNAVILQNAWKVSCTILAVVSVSPLFLTSSQQKADWIPLALTIKGLNPTAIFLTTLSRTNKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGLFPVSIPITAAAWYLWEVKKQRAGVLWDVPSPPPVGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNAGTIGAVSLDFSPGTSGSPIIDRKGKVVGLYGNGVVTRSGAYVSAIAQTEKSIEDNPEIEDDIFRKRKLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWSSGHEWVTDFKGKTVWFVPSIRAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGIKNNQILEENVEVEIWTKEGERKKLKPRWLDARIYSDPLALKEFKEFAAGRKSLTLNLITEMGRLPTFMTQKARDALDNLAVLHTAEAGGRAYNHALSELPETLETLLLLTLLATVTGGIFLFLMSGRGIGKMTLGMCCIITASILLWYAQIQPHWIAASIILEFFLIVLLIPEPEKQRTPQDNQLTYVVIAILTVVAATMANEMGFLEKTKKDLGLGSITTQQPESNILDIDLRPASAWTLYAVATTFVTPMLRHSIENSSVNVSLTAIANQATVLMGLGKGWPLSKMDIGVPLLAIGCYSQVNPITLTAALFLLVAHYAIIGPGLQAKATREAQKRAAAGIMKNPTVDGITVIDLDPIPYDPKFEKQLGQVMLLVLCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESEIPNLDIIGKRIEKIKQEYETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKNIQHLTVTEEIAVQNWLARVGRERLSRMAISGDDCVVKPLDDRFASALTALNDMGKVRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIQENPWMEDKTPVESWEEIPYLGKREDQWCGSLIGLTSRATWAKNIQTAINQVRSLIGNEEYTDYMPSMKRFRREEEEAGVLW

SEQ ID NO: 3765 - protein, 3291 aa, Artificial Sequence
  derived and/or modified protein sequence (wt) from DENV-2__KF704354__SS-prME
TAGMIIMLIPTVMAFHLTTRNGEPHMIVSRQEKGKSLLFKTEDGVNMCTLMAMDLGELCEDTITYKCPFLRQNEPEDIDCWCNSTSTWVTYGTCTTTGEHRREKRSVALVPHVGMGLETRTETWMSSEGAWKHAQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFVCKHSMVDRGWGNGCGLFGKGGIVTCAMFTCKKIMKGKVVQPENLEYTIVITPHSGEEHAVGNDTGKHGKEIKITPQSSITEAELTGYGTVTMECSPRTGLDFNEMVLLQMENKAWLVHRQWFLDLPLPWLPGADTQGSNWIQKETLVTFKNPHAKKQDVVVLGSQEGAMHTALTGATEIQMSSGNVLFTGHLKCRLRMDKLQLKGMSYSMCTGKFKVVKEIAETQHGTIVIRVQYEGDGSPCKIPFEIMDLEKRHVLGRLITVNPIVTGKDSPVNIEAEPPFGDSYIIIGVEPGQLKLNWFKKGSSIGQMFATTMRGAKRMAILGDTAWDFGSLGGVFTSIGKALHQVFGAIYGAAFSGVSWTMKILIGVIITWIGMNSRSTSLSVSLVLVGVVTLYLGVMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLREEQDVFCDSKLMSAAIKDNRAVHADMGYWIESALNDTWKIEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMTTIGIVLLSQSTIPETILELTDALALGMMVLKMVRKMEKYQLAVTIMAILCVPNAVILQNTWKVSCTILAVVSVSPLFLTSSQQKADWIPLALTIKGLNPTAIFLTTLSRTNKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGLFPVSIPITAAAWYLWEVKKQRAGVLWDVPSPPPVGKAELEDGAYRIKQKGILGYSQIGAGVYKEGTFHTMWHVTRGAVLMHKGKRIEPSWADVKKDLISYGGGWRLEGEWKEGEEVQVLALEPGKNPRAVQTKPGLFKTNAGTIGAVSLDFSPGTSGSPIIDKKGKVVGLYGNGVVTRSGAYVSAIAQTEKSIEDNPEIEDDIFRKRKLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWSSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGIKNNQILEENVEVEIWTKEGERKKLKPRWLDARIYSDPLALKEFKEFAAGRKSLTLNLITEMGRLPTFMTQKARDALDNLAVLHTAEAGGRAYNHALSELPETLETLLLLTLLATVTGGIFLFLMSGRGIGKMTLGMCCIITASILLWYAQIQPHWIAASIILEFFLIVLLIPEPEKQRTPQDNQLTYVVIAILTVVAATMANEMGFLEKTKKDLGWGSITTQQPESNILDIDLRPASAWTLYAVATTFVTPMLRHSIENSSVNVSLTAIANQATVLMGLGKGWPLSKMDIGVPLLAIGCYSQVNPITLTAALFLLVAHYAIIGPGLQAKATREAQKRAAAGIMKNPTVDGITVIDLDPIPYDPKFEKQLGQVMLLVLCVTQVLMMRTTWALCEALTLATGPISTLWEGNPGRFWNTTIAVSMANIFRGSYLAGAGLLFSIMKNTTNTRRGTGNMGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATFEPDVDLGSGTRNIGIESEIPNLDIIGKRIEKIKQEYETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKNIQHLTVTEEIAVQNWLARVGRERLSRMAISGDDCVVKPLDDRFASALTALNDMGKVRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIQENPWMEDKTPVESWEEIPYLGKREDQWCGSLIGLTSRATWAKNIQTAINQVRSLIGNEEYTDYMPSMKRFRREEEEAGVLW

SEQ ID NO: 3766 - protein, 3291 aa, Artificial Sequence
  derived and/or modified protein sequence (wt) from DENV-2__KF704357__SS-prME
TAGMIIMLIPTVMAFHLTTRNGEPHMIVSRQEKGKSLLFKTGDGVNMCTLMAMDLGELCEDTITYKCPLLRQNEPEDIDCWCNSTSTWVTYGTCTTTGEHRREKRSVALVPHVGMGLETRTETWMSSEGAWKHAQRIETWILRHPGFTIMAAILAYTIGTTHFQRALIFILLTAVAPSMTMRCIGISNRDFVEGVSGGSWVDIVLEHGSCVTTMAKNKPTLDLELIKTEAKQPATLRKYCIEAKLTNTTTESRCPTQGEPSLNEEQDKRFVCKHSMVDRGWGNGCGLFGKGSIVTCAMFTCKKIMKGKVVQPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNVLFTGHLKCRLRMDKLQLKGMSYSMCTGKFKVVKEIAETQHGTIVIRVQYEGDGSPCKIPFEIMDLEKRHVLGRLITVNPIVTGKDSPVNIEAEPPFGDSYIIIGVEPGQLKLNWFKKGSSIGQMFATTMRGAKRMAILGDTAWDFGSLGGVFTSIGKALHQVFGAIYGAAFSGVSWTMKILIGVIITWIGMNSRSTSLSVSLVLVGVVTLYLGVMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLREEQDVFCDSKLMSAAIKDNRAVHADMGYWIESALNDTWKIEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMTTIGIVLLSQSTIPETILELTDALALGMMVLKMVRKMEKYQLAVTIMAILCVPNAVILQNTWKVSCTILAVVSVSPLFLTSSQQKADWIPLALTIKGLNPTAIFLTTLSRTNKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGLFPVSIPITAAAWYLWEVKKQRAGVLWDVPSPPPVGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNAGTIGAVSLDFSPGTSGSPIIDRKGKVVGLYGNGVVTRSGAYVSAIAQTEKSIEDNPEIEDDIFRKRKLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWSSGHEWVTDFKGKTVWFVPSIRAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGIKNNQILEENVEVEIWTKEGERKKLKPRWLDARIYSDPLALKEFKEFAAGRKSLTLNLITEMGRLPTFMTQKARDALDNLAVLHTAEAGGRAYNHALSELPETLETLLLLTLLATVTGGIFLFLMSGRGIGKMTLGMCCIITASILLWYAQIQPHWIAASIILEFFLIVLLIPEPEKQRTPQDNQLTYVVIAILTVVAATMANEMGFLEKTKKDLGLGSITTQQPESNILDIDLRPASAWTLYAVATTFVTPMLRHSIENSSVNVSLTAIANQATVLMGLGKGWPLSKMDIGVPLLAIGCYSQVNPITLTAALFLLVAHYAIIGPGLQAKATREAQKRAAAGIMKNPTVDGITVIDLDPIPYDPKFEKQLGQVMLLVLCVTQVLMMRTTWALCEALTLATGPISTLWEGNPGRFWNTTIAVSMANIFRGSYLAGAGLLFSIMKNTTNTRRGTGNMGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATFEPDVDLGSGTRNIGIESEIPNLDIIGKRIEKIKQEYETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKNIQHLTVTEEIAVQNWLARVGRERLSRMAISGDDCVVKPLDDRFASALTALNDMGKVRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIQENPWMEDKTPVESWEEIPYLGKREDQWCGSLIGLTSRATWAKNIQTAINQVRSLIGNEEYTDYMPSMKRFRREEEEAGVLW

SEQ ID NO: 3767 - protein, 3291 aa, Artificial Sequence
  derived and/or modified protein sequence (wt) from DENV-2__KF704358__SS-prME
TAGMIIMLIPTVMAFHLTTRNGEPHMIVSRQEKGKSLLFNTGDGVHMCTLMAMHLGELCEDTITYKCPLLRQNEPEDIDCWCNSTSTWVTYGTCTTTGEHRREKRSVALVPHVGMGLETRTETWMSSEGAWKHAQRIETWILRHPGFTIMAAILAYTIGTTHFQRALIFILLTAVAPSMTMRCIGISNRDFVEGVSGGSWVDIVLEHGSCVTTMAKNKPTLDLELIKTEAKQPATLRKYCIEAKLTNTTTESRCPTQGEPSLNEEQDKRFVCKHSMVDRGWGNGCGLFGKGSIVTCAMFTCKKIMKGKVVQPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNVLFTGHLKCRLRMDKLQLKGMSYSMCTGKFKVVKEIAETQHGTIVIRVQYEGDGSPCKIPFEIMDLEKRHVLGRLITVNPIVTGKDSPVNIEAEPPFGDSYIIIGVEPGQLKLNWFKKGSSIGQMFATTMRGAKRMAILGDTAWDFGSLGGVFTSIGKALHQVFGAIYGAAFSGVSWTMKILTGVIITWIGMNSRSTSLSVSLVLVGVVTLYLGVMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKIEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMTTIGIVLLSQSTIPETILELTDALALGMMVLKMVRKMEKYQLAVTIMAILCVPNAVILQNTWKVSCTILAVVSVSPLFLTSSQQKADWIPLALTIKGLNPTAIFLTTLSRTNKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGLFPVSIPITAAAWYLWEVKKQRAGVLWDVPSPPPVGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNAGTIGAVSLDFSPGTSGSPIIDKKGKVVGLYGNGVVTRSGAYVSAIAQTEKSIEDNPEIEDDIFRKRKLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWSSGHEWVTDFKGKTVWFVPSIRAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGIKNNQILEENVEVEIWTKEGERKKLKPRWLDARIYSDPLALKEFKEFAAGRKSLTLNLITEMGRLPTFMTQKARDALDNLAVLHTAEAGGRAYNHALSELPETLETLLLLTLLATVTGGIFLFLMSGRGIGKMTLGMCCIITASILLWYAQIQPHWIAASIILEFFLIVLLIPEPEKQRTPQDNQLTYVVIAILTVVAATMANEMGFLEKTKKDLGLGSITTQQPESNILDIDLRPASAWTLYAVATTFVTPMLRHSIENSSVNVSLTAIANQATVLMGLGKGWPLSKMDIGVPLLAIGCYSQVNPITLTAALFLLVAHYAIIGPGLQAKATREAQKRAAAGIMKNPTVDGITVIDLDPIPYDPKFEKQLGQVMLLVLCVTQVLMMRTTWALCEALTLATGPISTLWEGNPGRFWNTTIAVSMANIFRGSYLAGAGLLFSIMKNTTNTRRGTGNMGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATFEPDVDLGSGTRNIGIESEIPNLDIIGKRIEKIKQEYETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKNIQHLTVTEEIAVQNWLARVGRERLSRMAISGDDCVVKPLDDRFASALTALNDMGKVRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIQENPWMEDKTPVESWEEIPYLGKREDQWCGSLIGLTSRATWAKNIQTAINQVRSLIGNEEYTDYMPSMKRFRREEEEAGVLW

SEQ ID NO: 3768 - protein, 3291 aa, Artificial Sequence
  derived and/or modified protein sequence (wt) from DENV-2__KF041232__SS-prME
TAGVIIMLIPTAMAFHLTTRNGEPHMIVSKQEKGKSLLFKTEDGVNMCTLMAMDLGELCEDTITYNCPLLRQNEPEDIDCWCNATSTWVTYGTCTATGEHRREKRSVALVPHVGMGLETRTETWMSSEGAWKHAQRIETWILRHPGFTIMAAILAYTIGTTYFQRVLIFILLTAVAPSMTMRCIGISNRDFVEGVSGGSWVDIVLEHGSCVTTMAKNKPTLDFELIKTEAKQPATLRKYCIEAKLTNTTTASRCPTQGEPSLNEEQDKRFVCKHSMVDRGWGNGCGLFGKGGIVTCAMFTCKKNMEGKIVQPENLEYTIVVTPHSGEENAVGNDTGKHGKEIKVTPQSSITEAELTGYGTVTMECSPRTGLDFNEMVLLQMENKAWLVHRQWFLDLPLPWLPGADIQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVVRVQYEGDGSPCKIPFEIMDLEKRHVLGRLITVNPIVTEKDSPVNIEAEPPFGDSYIIIGVEPGQLKLSWFKKGSSIGQMFETTMRGAKRMAILGDTAWDFGSLGGVFTSIGKALHQVFGAIYGAAFSGVSWTMKILIGVVITWIGMNSRSTSLSVSLVLVGVVTLYLGAMVQADSGCVVSWKNKELKCGSGIFITDNVHTWTEQYKFQPESPSKLASAIQKAHEEGICGIRSVTRLENLMWKQITPELNHILSENEVKLSIMTGDIKGIMQAGKRSLRPQPTELKYSWKTWGKAKMLSTEPHNQTFLIDGPETAECPNTNRAWNSLEVEDYGFGVFTTNIWLKLKERQDVFCDSKLMSAAIKDNRAVHADMGYWIESALNDTWKIEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAVLLVAVSFMTLITGNMSFRDLGRVMVMVGAAMTDDIGMGVTYLALLAAFKVRPTFAAGLLLRKLTSKELMMTTIGIVLLSQSTTPETILELTDALALGMMILKIVRNMEKYQLAVTIMAILCVPNAVILQNAWKVSCTILAAVSVSPLLLTSSQQKADWIPLALTIKGLNPTAIFLTTLSRTNKKRSWPLNEAIMAVGMVSILASSLLKNDIPMTGPLVAGGLLTVCYVLTGRSADLELERAADVRWEDQAEISGSSPILSITISEDGSMSIKNEEEEQTLTILIRTGLLVISGLFPVSIPITAAAWYLWEVKKQRAGVLWDVPSPPPVGKAELEDGAYRIKQKGILGYSQIGAGVYKEGTFHTMWHVTRGAVLMHKGKRIEPSWADVRKDLISYGGGWKLEGEWKEGEEVQVLALEPGKNPRAVQTKPGLFKTNTGTIGAVSLDFSPGTSGSPIVDKKGKVVGLYGNGVVTRSGTYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYIKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGIKNNQILEENVEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDFGLGSIATQQPESNILDIDLRPASAWTLYAVATTFITPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLVLCVTQVLMMRTTWALCEALTLATGPISTLWEGNPGRFWNTTIAVSMANIFRGSYLAGAGLLFSIMKNTTNTRRGTGNTGETLGEKWKNRLNSLGKSEFQIYKRSGIQEVDRTLAKEGIKRGETDHHAVSRGSAKLRWFVERNLVTPEGKVVDLGCGRGGWSYYCGGLKNVREVKGLTKGGPGHEEPIPMSTYGWNLVRLQSGVDVFFTPPEKCDTLLCDIGESSPNPTVEAGRTLRVLNLVENWLNNNTQFCIKVLNPYMPSVIEKMETLQRKYGGALVRNPLSRNSTHEMYWVSNASGNIVSSVNMISRMLINRFTMRHKKATYEPDVDLGSGTRNIGIESETPNLDIIGKRIEKIKQEHETSWHYDQDHPYKTWAYHGSYETKQTGSASSMVNGVVRLLTKPWDVIPMVTQMAMTDTTPFGQQRVFKEKVDTRTQEPKEGTKKLMKITAEWLWKELGKKKTPRMCTREEFARKVRSNAALGAIFTDENKWKSAREAVEDSRFWELVDKERNLHLEGKCETCVYNMMGKREKKIGEFGKAKGSRAIWYMWLGARFLEFEALGFLNEDHWFSRENSLSGVEGEGLHKLGYILREVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMGAQLIRQMEGEGVFKGIQHLTATEEVAVQDWLARVGRERLSRMAISGDDCVVKPLDDRFANALTALNDMGKVRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHARHEWMTTEDMLTVWNRVWIQENPWMEDKTPVESWEEIPYLGKREDQWCGSLIGLTSRATWARNIQTAINQVRSLIGSEEYTDYMPSMKRFRREEEEAGVLW

SEQ ID NO: 3769 - protein, 3291 aa, Artificial Sequence
  derived and/or modified protein sequence (wt) from DENV-2__KF041233__SS-prME
TAGVIIMLIPTAMAFHLTTRNGEPHMIVSKQEKGKSLLFKTEDGVNMCTLMAMDLGELCEDTITYNCPLLRQNEPEDIDCWCNSTSTWVTYGTCTATGEHRREKRSVALVPHVGMGLETRTETWMSSEGAWKHAQRIETWILRHPGFTIMAAILAYTIGTTYFQRVLIFILLTAVAPSMTMRCIGISNRDFVEGVSGGSWVDIVLEHGSCVTTMAKNKPTLDFELIKTEAKQPATLRKYCIEAKLTNTTTASRCPTQGEPSLNEEQDKRFVCKHSMVDRGWGNGCGLFGKGGIVTCAMFTCKKNMEGKIVQPENLEYTIVVTPHSGEENAVGNDTGKHGKEIKVTPQSSITEAELTGYGTVTMECSPRTGLDFNEMVLLQMENKAWLVHRQWFLDLPLPWLPGADIQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVVRVQYEGDGSPCKIPFEIMDLEKRHVLGRLITVNPIVTEKDSPVNIEAEPPFGDSYIIIGVEPGQLKLSWFKKGSSIGQMFETTMRGAKRMAILGDTAWDFGSLGGVFTSIGKALHQVFGAIYGAAFSGVSWTMKILIGVVITWIGMNSRSTSLSVSLVLVGVVTLYLGVMVQADSGCVVSWKNKELKCGSGIFITDNVHTWTEQYKFQPESPSKLAAAIQKAHEEGICGIRSVTRLENLMWKQITPELNHILSENEVKLSIMTGDIKGIMQAGKRSLRPQPTELKYSWKTWGKAKMLSTEPHNQTFLIDGPETAECPNTNRAWNSLEVEDYGFGVFTTNIWLKLKERQDVFCDSKLMSAAIKDNRAVHADMGYWIESALNDTWKIEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAVLLIAVSFMTLITGNMSFRDLGRVMVMVGAAMTDDIGMGVTYLALLAAFKVRPTFAAGLLLRKLTSKELMMTTIGIVLLSQSTTPETILELTDALALGMMILKIVRNMEKYQLAVTIMAILCVPNAVILQNAWKVSCTILAAVSVSPLLLTSSQQKADWIPLALTIKGLNPTAIFLTTLSRTNKKRSWPLNEAIMAVGMVSILASSLLKNDIPMTGPLVAGGLLTVCYVLTGRSADLELERAADVRWEDQAEISGSSPILSITISEDGSMSIKNEEEEQTLTILIRTGLLVISGLFPVSIPITAAAWYLWEVKKQRAGVLWDVPSPPPVGKAELEDGAYRIKQKGILGYSQIGAGVYKEGTFHTMWHVTRGAVLMHKGKRIEPSWADVRKDLISYGGGWKLEGEWKEGEEVQVLALEPGKNPRAVQTKPGLFKTNTGTIGAVSLDFSPGTSGSPIVDKKGKVVGLYGNGVVTRSGTYVSAIAQTEKSIEDNPEIEDDIFRKKKLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYIKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGIKNNQILEENVEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDFGLGSIATQQPESNILDIDLRPASAWTLYAVATTFITPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLVLCVTQVLMMRTTWALCEALTLATGPISTLWEGNPGRFWNTTIAVSMANIFRGSYLAGAGLLFSIMKNTTNTRRGTGNTGETLGEKWKNRLNSLGKSEFQIYKRSGIQEVDRTLAKEGIKRGETDHHAVSRGSAKLRWFVERNLVTPEGKVVDLGCGRGGWSYYCGGLKNVREVKGLTKGGPGHEEPIPMSTYGWNLVRLQSGVDVFFTPPEKCDTLLCDIGESSPNPTVEAGRTLRVLNLVENWLNNNTQFCIKVLNPYMPSVIEKMETLQRKYGGALVRNPLSRNSTHEMYWVSNASGNIVSSVNMISRMLINRFTMRHKKATYEPDVDLGSGTRNIGIESETPNLDIIGKRIEKIKQEHETSWHYDQDHPYKTWAYHGSYETKQTGSASSMVNGVVRLLTKPWDVIPMVTQMAMTDTTPFGQQRVFKEKVDTRTQEPKEGTKKLMKITAEWLWKELGKKKTPRMCTREEFARKVRSNAALGAIFTDENKWKSAREAVEDSRFWELVDKERNLHLEGKCETCVYNMMGKREKKIGEFGKAKGSRAIWYMWLGARFLEFEALGFLNEDHWFSRENSLSGVEGEGLHKLGYILREVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMGAQLIRQMEGEGVFKGIQHLTATEEVAVQDWLARVGRERLSRMAISGDDCVVKPLDDRFASALTALNDMGKVRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHARHEWMTTEDMLTVWNRVWIQENPWMEDKTLVESWEEIPYLGKREDQWCGSLIGLTSRATWARNIQTAINQVRSLIGSEEYTDYMPSMKRFRREEEEAGVLW

SEQ ID NO: 3770 - protein, 3291 aa, Artificial Sequence
  derived and/or modified protein sequence (wt) from DENV-2__KF041234__SS-prME
TAGVIIMLIPTAMAFHLTTRNGEPHMIVSKQEKGKSLLFKTEDGVNMCTLMAMDLGELCEDTITYNCPLLRQNEPEDIDCWCNATSTWVTYGTCTATGEHRREKRSVALVPHVGMGLETRTETWMSSEGAWKHAQRIETWILRHPGFTIMAAILAYTIGTTYFQRVLIFILLTAVAPSMTMRCIGISNRDFVEGVSGGSWVDIVLEHGSCVTTMAKNKPTLDFELIKTEAKQPATLRKYCIEAKLTNTTTASRCPTQGEPSLNEEQDKRFVCKHSMVDRGWGNGCGLFGKGGIVTCAMFTCKKNMEGKIVQPENLEYTIVVTPHSGEENAVGNDTGKHGKEIKVTPQSSITEAELTGYGTVTMECSPRTGLDFNEMVLLQMENKAWLVHRQWFLDLPLPWLPGADIQGSNWIQKETLVTFKNPHAKKQDVVVLGSQEGAMHTALTGATEIQMSSGNLLFTGHLKCRLRMDKLQLKGMSYSMCTGKFKVIKEIAETQHGTIVVRVQYEGDGSPCKIPFEIMDLEKRHVLGRLITVNPIVTEKDSPVNIEAEPPFGDSYIIIGVEPGQLKLSWFKKGSSIGQMFETTMRGAKRMAILGDTAWDFGSLGGVFTSIGKALHQVFGAIYGAAFSGVSWTMKILIGVVITWIGMNSRSTSLSVSLVLVGVVTLYLGVMVQADSGCVVSWKNKELKCGSGIFITDNVHTWTEQYKFQPESPSKLASAIQKAHEEGICGIRSVTRLENLMWKQITPELNHILSENEVKLSIMTGDIKGIMQAGKRSLRPQPTELKYSWKTWGKAKMLSTEPHNQTFLIDGPETAECPNTNRAWNSLEVEDYGFGVFTTNIWLKLKERQDVFCDSKLMSAAIKDNRAVHADMGYWIESALNDTWKIEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAVLLVAVSFMTLITGNMSFRDLGRVMVMVGAAMTDDIGMGVTYLALLAAFKVRPTFAAGLLLRKLTSKELMMTTIGIVLLSQSTTPETILELTDALALGMMILKIVRNMEKYQLAVTIMAILCVPNAVILQNAWKVSCTILAAVSVSPLLLTSSQQKADWIPLALTIKGLNPTAIFLTTLSRTNKKRSWPLNEAIMAVGMVSILASSLLKNDIPMTGPLVAGGLLTVCYVLTGRSADLELERAADVRWEDQAEISGSSPILSITISEDGSMSIKNEEEEQTLTILIRTGLLVISGLFPVSIPITAAAWYLWEVKKQRAGVLWDVPSPPPVGKAELEDGAYRIKQKGILGYSQIGAGVYKEGTFHTMWHVTRGAVLMHKGKRIEPSWADVRKDLISYGGGWKLEGEWKEGEEVQVLALEPGKNPRAVQTKPGLFKTNTGTIGAVSLDFSPGTSGSPIVDKKGKVVGLYGNGVVTRSGTYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYIKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGIKNNQILEENVEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDFGLGSIATQQPESNILDIDLRPASAWTLYAVATTFITPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLVLCVTQVLMMRTTWALCEALTLATGPISTLWEGNPGRFWNTTIAVSMANIFRGSYLAGAGLLFSIMKNTTNTRRGTGNTGETLGEKWKNRLNSLGKSEFQIYKRSGIQEVDRTLAKEGIKRGETDHHAVSRGSAKLRWFVERNLVTPEGKVVDLGCGRGGWSYYCGGLKNVREVKGLTKGGPGHEEPIPMSTYGWNLVRLQSGVDVFFTPPEKCDTLLCDIGESSPNPTVEAGRTLRVLNLVENWLNNNTQFCIKVLNPYMPSVIEKMETLQRKYGGALVRNPLSRNSTHEMYWVSNASGNIVSSVNMISRMLINRFTMRHKKATYEPDVDLGSGTRNIGIESETPNLDIIGKRIEKIKQEHETSWHYDQDHPYKTWAYHGSYETKQTGSASSMVNGVVRLLTKPWDVIPMVTQMAMTDTTPFGQQRVFKEKVDTRTQEPKEGTKKLMKITAEWLWKELGKKKTPRMCTREEFARKVRSNAALGAIFTDENKWKSAREAVEDSRFWELVDKERDLHLEGKCETCVYNMMGKREKKIGEFGKAKGSRAIWYMWLGARFLEFEALGFLNEDHWFSRENSLSGVEGEGLHKLGYILREVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMGAQLIRQMEGEGVFKGIQHLTATEEVAVQDWLARVGRERLSRMAISGDDCVVKPLDDRFANALTALNDMGKVRKDIQQWEPSRGWSDWTQVPFCSHHFHELIMKDGRVLVVPCRNQDELIGRARISQGAGWSLRETACLGKSYAQMWSLMYFHRRDLRLAANAICSAVPSHWVPTSRTTWSIHARHEWMTTEDMLTVWNRVWIQENPWMEDKTPVESWEEIPYLGKREDQWCGSLIGLTSRATWARNIQTAINQVRSLIGSEEYTDYMPSMKRFRREEEEAGVLW

SEQ ID NO: 3771 - protein, 3291 aa, Artificial Sequence
  derived and/or modified protein sequence (wt) from DENV-2__KF041235__SS-prME
TAGVIIMLIPTAMAFHLTTRNGEPHMIVSKQEKGKSLLFKTEDGVNMCTLMAMDLGELCEDTITYNCPLLRQNEPEDIDCWCNSTSTWVTYGTCTATGEHRREKRSVALVPHVGMGLETRTETWMSSEGAWKHAQRIETWILRHPGFTIMAAILAYTIGTTYFQRVLIFILLTAVAPSMTMRCIGISNRDFVEGVSGGSWVDIVLEHGSCVTTMAKNKPTLDFELIKTEAKQPATLRKYCIEAKLTNTTTASRCPTQGEPSLNEEQDKRFVCKHSMVDRGWGNGCGLFGKGGIVTCAMFTCKKNMEGKIVQPENLEYTIVVTPHSGEENAVGNDTGKHGKEIKVTPQSSITEAELTGYGTVTMECSPRTGLDFNEMVLLQMENKAWLVHRQWFLDLPLPWLPGADIQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVVRVQYEGDGSPCKIPFEIMDLEKRHVLGRLITVNPIVTEKDSPVNIEAEPPFGDSYIIIGVEPGQLKLSWFKKGSSIGQMFETTMRGAKRMAILGDTAWDFGSLGGVFTSIGKALHQVFGAIYGAAFSGVSWTMKILIGVVITWIGMNSRSTSLSVSLVLVGVVTLYLGVMVQADSGCVVSWKNKELKCGSGIFITDNVHTWTEQYKFQPESPSKLASAIQKAHEEGICGIRSVTRLENLMWKQITPELNHILSENEVKLSIMTGDIKGIMQAGKRSLRPQPTELKYSWKTWGKAKMLSTEPHNQTFLIDGPETAECPNTNRAWNSLEVEDYGFGVFTTNIWLKLKERQDVFCDSKLMSAAIKDNRAVHADMGYWIESALNDTWKIEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAVLLVAVSFMTLITGNMSFRDLGRVMVMVGAAMTDDIGMGVTYLALLAAFKVRPTFAAGLLLRKLTSKELMMTTIGIVLLSQSTTPETILELTDALALGMMILKIVRNMEKYQLAVTIMAILCVPNAVILQNAWKVSCTILAAVSVSPLLLTSSQQKADWIPLALTIKGLNPTAIFLTTLSRTNKKRSWPLNEAIMAVGMVSILASSLLKNDIPMTGPLVAGGLLTVCYVLTGRSADLELERAADVRWEDQAEISGSSPILSITISEDGSMSIKNEEEEQTLTILIRTGLLVISGLFPVSIPITAAAWYLWEVKKQRAGVLWDVPSPPPVGKAELEDGAYRIKQKGILGYSQIGAGVYKEGTFHTMWHVTRGAVLMHKGKRIEPSWADVRKDLISYGGGWKLEGEWKEGEEVQVLALEPGKNPRAVQTKPGLFKTNTGTIGAVSLDFSPGTSGSPIVDKKGKVVGLYGNGVVTRSGTYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYIKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGIKNNQILEENVEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDFGLGSIATQQPESNILDIDLRPASAWTLYAVATTFITPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLVLCVTQVLMMRTTWALCEALTLATGPISTLWEGNPGRFWNTTIAVSMANIFRGSYLAGAGLLFSIMKNTTNTRRGTGNTGETLGEKWKNRLNSLGKSEFQIYKRSGIQEVDRTLAKEGIKRGETDHHAVSRGSAKLRWFVERNLVTPEGKVVDLGCGRGGWSYYCGGLKNVREVKGLTKGGPGHEEPIPMSTYGWNLVRLQSGVDVFFTPPEKCDTLLCDIGESSPNPTVEAGRTLRVLNLVENWLNNNTQFCIKVLNPYMPSVIEKMETLQRKYGGALVRNPLSRNSTHEMYWVSNASGNIVSSVNMISRMLINRFTMRHKKATYEPDVDLGSGTRNIGIESETPNLDIIGKRIEKIKQEHETSWHYDQDHPYKTWAYHGSYETKQTGSASSMVNGVVRLLTKPWDVIPMVTQMAMTDTTPFGQQRVFKEKVDTRTQEPKEGTKKLMKITAEWLWKELGKKKTPRMCTREEFARKVRSNAALGAIFTDENKWKSAREAVEDSRFWELVDKERNLHLEGKCETCVYNMMGKREKKIGEFGKAKGSRAIWYMWLGARFLEFEALGFLNEDHWFSRENSLSGVEGEGLHKLGYILREVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMGAQLIRQMEGEGVFKGIQHLTATEEVAVQDWLARVGRERLSRMAISGDDCVVKPLDDRFASALTALNDMGKVRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHARHEWMTTEDMLTVWNRVWIQENPWMEDKTPVESWEEIPYLGKREDQWCGSLIGLTSRATWARNIQTAINQVRSLIGSEEYTDYMPSMKRFRREEEEAGVLW

SEQ ID NO: 3772 - protein, 3291 aa, Artificial Sequence
  derived and/or modified protein sequence (wt) from DENV-2__KF041237__SS-prME
TAGVIIMLIPTAMAFHLTTRNGEPHMIVSKQEKGKSLLFKTEDGVNMCTLMAMDLGELCEDTITYNCPLLRQNEPEDIDCWCNSTSTWVTYGTCTATGEHRREKRSVALVPHVGMGLETRTETWMSSEGAWKHAQRIETWILRHPGFTIMAAILAYTIGTTYFQRVLIFILLTAVAPSMTMRCIGISNRDFVEGVSGGSWVDIVLEHGSCVTTMAKNKPTLDFELIKTEAKQPATLRKYCIEAKLTNTTTASRCPTQGEPSLNEEQDKRFVCKHSMVDRGWGNGCGLFGKGGIVTCAMFTCKKNMEGKIVQPENLEYTIVVTPHSGEENAVGNDTGKHGKEIKVTPQSSITEAELTGYGTVTMECSPRTGLDFNEMVLLQMENKAWLVHRQWFLDLPLPWLPGADIQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVVRVQYEGDGSPCKIPFEIMDLEKRHVLGRLITVNPIVTEKDSPVNIEAEPPFGDSYIIIGVEPGQLKLSWFKKGSSIGQMFETTMRGAKRMAILGDTAWDFGSLGGVFTSIGKALHQVFGAIYGAAFSGVSWTMKILIGVVITWIGMNSRSTSLSVSLVLVGVVTLYLGVMVQADSGCVVSWKNKELKCGSGIFITDNVHTWTEQYKFQPESPSKLASAIQKAHEEGICGIRSVTRLENLMWKQITPELNHILSENEVKLSIMTGDIKGIMQAGKRSLRPQPTELKYSWKTWGKAKMLSTEPHNQTFLIDGPETAECPNTNRAWNSLEVEDYGFGVFTTNIWLKLKERQDVFCDSKLMSAAIKDNRAVHADMGYWIESALNDTWKIEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAVLLVAVSFMTLITGNMSFRDLGRVMVMVGAAMTDDIGMGVTYLALLAAFKVRPTFAAGLLLRKLTSKELMMTTIGIVLLSQSTTPETILELTDALALGMMILKIVRNMEKYQLAVTIMAILCVPNAVILQNAWKVSCTILAAVSVSPLLLTSSQQKADWIPLALTIKGLNPTAIFLTTLSRTNKKRSWPLNEAIMAVGMVSILASSLLKNDIPMTGPLVAGGLLTVCYVLTGRSADLELERAADVRWEDQAEISGSSPILSITISEDGSMSIKNEEEEQTLTILIRTGLLVISGLFPVSIPITAAAWYLWEVKKQRAGVLWDVPSPPPVGKAELEDGAYRIKQKGILGYSQIGAGVYKEGTFHTMWHVTRGAVLMHKGKRIEPSWADVRKDLISYGGGWKLEGEWKEGEEVQVLALEPGKNPRAVQTKPGLFKTNTGTIGAVSLDFSPGTSGSPIVDKKGKVVGLYGNGVVTRSGTYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYIKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGIKNNQILEENVEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDFGLGSIATQQPESNILDIDLRPASAWTLYAVATTFITPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLVLCVTQVLMMRTTWALCEALTLATGPISTLWEGNPGRFWNTTIAVSMANIFRGSYLAGAGLLFSIMKNTTNTRRGTGNTGETLGEKWKNRLNSLGKSEFQIYKRSGIQEVDRTLAKEGIKRGETDHHAVSRGSAKLRWFVERNLVTPEGKVVDLGCGRGGWSYYCGGLKNVREVKGLTKGGPGHEEPIPMSTYGWNLVRLQSGVDVFFTPPEKCDTLLCDIGESSPNPTVEAGRTLRVLNLVENWLNNNTQFCIKVLNPYMPSVIEKMETLQRKYGGALVRNPLSRNSTHEMYWVSNASGNIVSSVNMISRMLINRFTMRHKKATYEPDVDLGSGTRNIGIESETPNLDIIGKRIEKIKQEHETSWHYDQDHPYKTWAYHGSYETKQTGSASSMVNGVVRLLTKPWDVIPMVTQMAMTDTTPFGQQRVFKEKVDTRTQEPKEGTKKLMKITAEWLWKELGKKKTPRMCTREEFARKVRSNAALGAIFTDENKWKSAREAVEDSRFWELVDKERNLHLEGKCETCVYNMMGKREKKIGEFGKAKGSRAIWYMWLGARFLEFEALGFLNEDHWFSRENSLSGVEGEGLHKLGYILREVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMGAQLIRQMEGEGVFKGIQHLTATEEVAVQDWLARVGRERLSRMAISGDDCVVKPLDDRFASALTALNDMGKVRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAGHEWMTTEDMLTVWNRVWIQENPWMEDKTPVESWEEIPYLGKREDQWCGSLIGLTSRATWARNIQTAINQVRSLIGSEEYTDYMPSMKRFRREEEEAGVLW

SEQ ID NO: 3773 - protein, 3291 aa, Artificial Sequence
  derived and/or modified protein sequence (wt) from DENV-2__KM217156__SS-prME
TAGVIIMLIPTAMAFHLTTRNGEPHMIVSKQEKGKSLLFKTEDGVNMCTLMAMDLGELCEDTITYNCPLLRQNEPEDIDCWCNATSTWVTYGTCTATGEHRREKRSVALVPHVGMGLETRTETWMSSEGAWKHAQRIETWILRHPGFTIMAAILAYTIGTTYFQRVLIFILLTAVAPSMTMRCIGISNRDFVEGVSGGSWVDIVLEHGSCVTTMAKNKPTLDFELIKTEAKQPATLRKYCIEAKLTNTTTASRCPTQGEPSLNEEQDKRFVCKHSMVDRGWGNGCGLFGKGGIVTCAMFTCKKNMEGKIVQPENLEYTIVVTPHSGEENAVGNDTGKHGKEIKVTPQSSITEAELTGYGTVTMECSPRTGLDFNEMVLLQMENKAWLVHRQWFLDLPLPWLPGADIQGSNWIQKETLVTFKNPHAKKQDVVVLGSQEGAMHTALTGATEIQMSSGNPLFTGHLKCRLRMDKLQLKGMSYSMCTGKFKVVKEIAETQHGTIVVRIQYEGDGSPCKIPFEIMDLEKRHVLGRLITVNPIVTEKDSPVNIEAEPPFGDSYIIIGVEPGQLKLSWFKKGSSIGQMFETTMRGAKRMAILGDTAWDFGSLGGVFTSIGKALHQVFGAIYGAAFSGVSWTMKILIGVVITWIGMNSRSTSLSVSLVLVGVVTLYLGVMVQADSGCVVSWKNKELKCGSGIFFTDNVHTWTEQYKFQPESPSKLASAIQKAHEEGICGIRSITRLDNLMWKQITPELNHILSENEVKLSIMTGDIKGIMQAGKRSLRPQPTELKYSWKTWGKAKMLSTEPHNQTFLIDGPETAQCPNTNRAWNSLEVEDYGFGVFTTNIWLKLKERQDVFCDSKLMSAAIKDNRAVHADMGYWIESALNDTWKIEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAVLLVAVSFMTLITGNMSFRDLGRVMVMVGAAMTDDIGMGVTYLALLAAFKVRPTFAAGLLLRKLTSKELMMTTIGIVLLSQSTTPETILELTDALALGMMILKIVRNMEKYQLAVTIMAILCVPNAVILQNAWKVSCTILAAVSVSPLLLTSSQQKADWIPLALTIKGLNPTAIFLTTLSRTNKKRSWPLNEAIMAVGMVSILASSLLKNDIPMTGPLVAGGLLTVCYVLTGRSADLELERAADVRWEDQAEISGSSPILSITISEDGSMSIKNEEEEQTLTILIRTGLLVISGLFPVSIPITAAAWYLWEVKKQRAGVLWDVPSPPPVGKAELEDGAYRIKQKGILGYSQIGAGVYKEGTFHTMWHVTRGAVLMHKGKRIEPSWADVRKDLISYGGGWKLEGEWKEGEEVQVLALEPGKNPRAVQTKPGLFKTNTGTIGAVSLDFSPGTSGSPIVDKKGKVVGLYGNGVVTRSGTYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYIKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGIKNNQILEENVEVEIWTKEGERKKLKPRWLDARIYSDPLALKEFKEFAAARKSLTLNLITEMGRLPTFMTQKARNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDFGLGSIATQQPESNILDIDLRPASAWTLYAVATTFITPMLRHSIENSSVNVSLTAIANQATVLMGLGKGWPLSKMDIGVPLLAIGCYSQVNPITLTAALLLLVAHYAIIGPGLQAKASREAQKRAAAGIMKNPTVDGITVIDLDPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNTGETLGEKWKNRVSLLGKSEFQIYKRSGIQEVDRTLAKEGIKRGETDHHAVSRGSAKLRWFVERNLVTPEGKVVDLGCGRGGWSYYCGGLKNVREVKGLTKGGPGHEEPIPMSTYGWNLVRLLTGADVFFTPPEKCDTLLCDIGESSPNPTVEAGRTLRVLNLVENWLNNNTQFCIKVLNPYMPSVIEKMETLQRKYGGALVRNPLSRNSTHEMYWVSNASGNIVSSVNMISRMLINRFTMRHKKATYDPDVDLGSGTRNIGIESETPNLDIIGKRIEKIKQEHETSRHYDQDHPYKTWAYHGSYETKQTGSASSTVNGVVRLLTKPWDVIPMVTQMAMTDTTPFGQQRVFKEKVDTRTQEPKEGTKKLMKITAEWLWKELGKKKTPRMCTREEFARKVRSNAALGAIFTDENKWKSAREAVEDSRFWELVDKERNLHLEGKCETCVYNMMGKREKKIGEFGKAKGSRAIWYMWLGARFLEFEALGFLNEDHWFSRENSLSGVEGEGLHKLGYILREVSKKEGGAMYADDTAGWDTRITLEDLKNEEMVTNHMEGEHKKLAEAIFKLTYQNKVVRVQRPTPRGTVMDIISRRDQRGSVQVGTYGLGTFTNMGAQLIRQMEGEGVFKGIQHLTATEEVAVQDWLARVGRERLSRMAISGDDCVVKPLDDRFASALTALNDMGKVRKDIQQWEPSRGWNDWTQVPFCSHHFHELIMKDGRVLVVACRNQDELIGRARISQGAGWSLRETACLGKSYAQMWSLMYFHRRDLRLAANAICSAVPSHWVPTSRTTWSIHAGHEWMTTEDMLTVWNRVWIQENPWMEDKTPVESWEEIPYLGKREDQWCGSLIGLTSRATWARNIQTAINQVRSLIGSEEYTDYMPSMKRFGREEEEAGVLW

SEQ ID NO: 3774 - protein, 3291 aa, Artificial Sequence
  derived and/or modified protein sequence (wt) from DENV-2__KX380809__SS-prME
TAGIIIMMIPTVMAFHLTTRNGEPHMIVSRQEKGKSLLFKTENGVNMCTLMAMDLGELCEDTITYNCPLLRQNEPEDIDCWCNSTSTWVTYGTCTATGEHRREKRSVALVPHVGMGLETRTETWMSSEGAWKHAQRIETWVLRHPGFTVMAAILAYTIGTTYFQRVLIFILLTAVAPSMTMRCIGISNRDFVEGVSGGSWVDIVLEHGSCVTTMAKNKPTLDFELIKTEAKHPATLRKYCIEAKLTNTTTASRCPTQGEPSLNEEQDKRFVCKHSMVDRGWGNGCGLFGKGGIVTCAMFTCKKNMEGKIVQPENLEYTIVITPHSGEENAVGNDTGKHGKEIKVTPQSSITEAELTGYGTATMECSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRHVLGRLITVNPIVTEKDSPVNIEAEPPFGDSYIIIGVEPGQLKLSWFKKGSSIGQMFETTMRGAKRMAILGDTAWDFGSLGGVFTSIGKALHQVFGAIYGAAFSGVSWTMKILIGVVITWIGMNSRSTSLSVSLVLVGIVTLYLGVMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKAWGKAKMLSTELHNHTFLIDGPETAECPNTNRAWNSLEVEDYGFGVFTTNIWLKLKERQDVFCDSKLMSAAIKDNRAVHADMGYWIESALNDTWKIEKASFIEVKSCHWPKSHTLWSNGVLESEMIIPKNFAGPVSQHNYRPGYHTQTAGPWHLGRLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMTTIGIVLLSQSTIPETILELTDALALGMMVLKIVRNMEKYQLAVTIMAILCVPNAVILQNAWKVSCTILAVVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVRWEEQAEISGSSPILSITISEDGSMSIKNEEEEQTLTILIRTGLLVISGLFPVSIPITAAAWYLWEVKKQRAGVLWDVPSPPPVGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIVDKKGKVVGLYGNGVVTRSGTYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPIRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYIKTRTNDWDFVVTTDISEMGANFKAERVIDPRRCMKPVILTDGEERVILAGPMPVTHSSAAQRRGRVGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGVKNNQILEENVEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDFGLGSITTQQPDSNILDIDLRPASAWTLYAVATTFITPMLRHSIENSSVNVSLTAIANQATVLMGLGKGWPLSKMDIGVPLLAIGCYSQVNPITLTAALLLLVAHYAIIGPGLQAKATREAQKRAAAGIMKIPTVDGITVIDLDPIPYDPKFEKQLGQVMLLVLCVTQVLMMRTTWALCEALTLATGPISTLWEGNPGRFWNTTIAVSMANIFRGSYLAGAGLLFSIMKNTANTRRGTGNTGETLGEKWKNRLNALGKSEFQIYKKSGIQEVDRTLAKEGIKRGETDHHAVSRGSAKLRWFVERNLVTPEGKVVDLGCGRGGWSYYCGGLKNVKEVKGLTKGGPGHEEPIPMSTYGWNLVRLQSGVDVFFTPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMKHKKATYEPDVDLGSGTRNIGIESETPNLDIIGKRIEKIKQEHETSWHYDQDHPYKTWAYHGSYETKQTGSASSMVNGVVRLLTKPWDVIPMVTQMAMTDTTPFGQQRVFKEKVDTRTQEPKEGTKKLMKITAEWLWKELGKKKTPRMCTREEFTRKVRSNAALGAIFTDENKWKSAREAVEDSGFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHRKLAEAIFRLTYQNKVVRVQRPTPRGTVMDIISRRDQRGSGQVVTYGLNTFTNMEAQLIRQMEGEGVFKSIQHLTVTEEIAVKNWLERVGRERLSRMAISGDDCVVKPLDDRFASALTALNDMGKVRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHATHEWMTTEDMLTVWNRVWIQENPWMEDKTPVESWEEIPYLGKREDQWCGSLIGLTSRATWAKNIQTAINQVRSLIGNEEYTDYMPSMKRFRREEEEAGVLW

SEQ ID NO: 3775 - protein, 3291 aa, Artificial Sequence
  derived and/or modified protein sequence (wt) from DENV-2__KX380810__SS-prME
TAGIIIMMIPTVMAFHLTTRNGEPHMIVSRQEKGKSLLFKTENGVNMCTLMAMDLGELCEDTITYNCPLLRQNEPEDIDCWCNSTSTWVTYGTCTATGEHRREKRSVALVPHVGMGLETRTETWMSSEGAWKHAQRIETWVLRHPGFTVMAAILAYTIGTTYFQRVLIFILLTAVAPSMTMRCIGISNRDFVEGVSGGSWVDIVLEHGSCVTTMAKNKPTLDFELIKTEAKHPATLRKYCIEAKLTNTTTASRCPTQGEPSLNEEQDKRFVCKHSMVDRGWGNGCGLFGKGGIVTCAMFTCKKNMEGKIVQPENLEYTIVITPHSGEENAVGNDTGKHGKEIKVTPQSSITEAELTGYGTATMECSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRHVLGRLITVNPIVTGKDSPVNIEAEPPFGDSYIIIGVEPGQLKLSWFKKGSSIGQMFETTMRGAKRMAILGDTAWDFGSLGGVFTSIGKALHQVFGAIYGAAFSGVSWTMKILIGVVITWIGMNSRSTSLSVSLVLVGIVTLYLGVMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKAWGKAKMLSTELHNHTFLIDGPETAECPNTNRAWNSLEVEDYGFGVFTTNIWLKLKERQDVFCDSKLMSAAIKDNRAVHADMGYWIESALNDTWKIEKASFIEVKSCHWPKSHTLWSNGVLESEMIIPKNFAGPVSQHNYRPGYHTQTAGPWHLGRLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMTTIGIVLLSQSTIPETILELTDALALGMMVLKIVRNMEKYQLAVTIMAILCVPNAVILQNAWKVSCTILAVVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVRWEEQAEISGSSPILSITISEDGSMSIKNEEEEQTLTILIRTGLLVISGLFPVSIPITAAAWYLWEVKKQRAGVLWDVPSPPPVGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIVDKKGKVVGLYGNGVVTRSGTYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPIRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYIKTRTNDWDFVVTTDISEMGANFKAERVIDPRRCMKPVILTDGEERVILAGPMPVTHSSAAQRRGRVGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGVKNNQILEENVEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDFGLGSITTQQPDSNILDIDLRPASAWTLYAVATTFITPMLRHSIENSSVNVSLTAIANQATVLMGLGKGWPLSKMDIGVPLLAIGCYSQVNPITLTAALLLLVAHYAIIGPGLQAKATREAQKRAAAGIMKIPAADIGTVIDLDPIPYDPKFEKQLGQVMLLVLCSTQVLMMRTTWALCEALTLATGPISTLWEGNPGRFWNTTIAVSMANIFRGSYLAGAGLLFSIMKNTANTRRGTGNTGETLGEKWKNRLNALGKSEFQIYKKSGIQEVDRTLAKEGIKRGETDHHAVSRGSAKLRWFVERNLVTPEGKVVDLGCGRGGWSYYCGGLKNVKEVKGLTKGGPGHEEPIPMSTYGWNLVRLQSGVDVFFTPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMKHKKATYEPDVDLGSGTRNIGIESETPNLDIIGKRIEKIKQEHETSWHYDQDHPYKTWAYHGSYETKQTGSASSMVNGVVRLLTKPWDVIPMVTQMAMTDTTPFGQQRVFKEKVDTRTQEPKEGTKKLMKITAEWLWKELGKKKTPRMCTREEFTRKVRSNAALGAIFTDENKWKSAREAVEDSGFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHRKLAEAIFRLTYQNKVVRVQRPTPRGTVMDIISRRDQRGSGQVVTYGLNTFTNMEAQLIRQMEGEGVFKSIQHLTVTEEIAVKNWLERVGRERLSRMAISGDDCVVKPLDDRFASALTALNDMGKVRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWVPISRTTWSIHATHEWMTTEDMLTVWNRVWIQENPWMEDKTPVESWEEIPYLGKREDQWCGSLIGLTSRATWAKNIQTAINQVRSLIGNEEYTDYMPSMKRFRREEEEAGVLW

SEQ ID NO: 3776 - protein, 3291 aa, Artificial Sequence
  derived and/or modified protein sequence (wt) from DENV-2__KX380811__SS-prME
TAGIIIMMIPTVMAFHLTTRNGEPHMIVSRQEKGKSLLFKTENGVNMCTLMAMDLGELCEDTITYNCPLLRQNEPEDIDCWCNSTSTWVTYGTCTATGEHRREKRSVALVPHVGMGLETRTETWMSSEGAWKHAQRIETWILRHPGFTIMAAILAYTIGTTYFQRVLIFILLTAVTPSMAMRCIGISNRDFVEGVSGGSWVDIVLEHGSCVTTMAKNKPTLDFELIKTEAKHLATLRKYCVEAKLTNTTTASRCPTQGEPSLNEEQDKRFVCKHSMVDRGWGNGCGLFGKGGIVTCAMFTCKKNMEGKVVQPENLEYTIVITPHSGEENAVGNDTGKHGKEIKVTPQSSITEAELTGYGTVTMECSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRHVLGRLITVNPIVTEKDSPVNIEAEPPFGDSYIIIGVEPGQLKLSWFKKGSSIGQMFETTMRGAKRMAILGDTAWDFGSLGGVFTSIGKALHQVFGAIYGAAFSGVSWTMKILIGVVITWIGMNSRSTSLSVSLVLVGVVTLYLGVMVQADSGCVVSWKNKELKCGSGIFITDNVHTWTEQYKFQPESPSKLASAIQKAHEEGICGIRSVTRLENLMWKQITPELNHILTENEVKLTIMTGDIKGIMQAGKRSLRPQPTELKYSWKAWGKAKMLSTELHNHTFLIDGPETAECPNTNRAWNSLEVEDYGFGVFTTNIWLKLKERQDVFCDSNLMSAAIKDNRAVHADMGYWIESALNDTWKIEKASFIEVKSCHWPKSHTLWSNGVLESEMIIPKNFAGPVSQHNYRPGYHTQTAGPWHLGRLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMTTIGIVLLSQSTIPESILELTDALALGMMVLKIVRNMEKYQLAVTIMAILCVPNAVILQNAWKVSCTTLAVVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVRWEEQAEISGSSPILSITISEDGSMSIKNEEEEQTLTILIRTGLLVISGLFPVSIPITAAAWYLWEVKKQRAGVLWDVPSPPPVGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIVDKKGKVVGLYGNGVVTRSGTYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPIRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYIKTRTNDWDFVVTTDISEMGANFKAERVIDPRRCMKPVILTDGEERVILAGPMPVTHSSAAQRRGRVGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGVKNNQILEENVEVEIWTKEGERKKLKPRWLDARIYSDPLALKEFKEFAAGRKSLTLNLITEMGRLPTFMTQKAKNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDFGLGSITTQQPESNILDIDLRPASAWTLYAVATTFITPMLRHSIENSSVNVSLTAIANQATVLMGLGKGWPLSKMDIGVPLLAIGCYSQVNPITLTAALLLLVAHYAIIGPGLQAKATREAQKRAAAGIMKIPTVDGMTVIDLDPIPYDPKFEKQLGQVMLLVLCVTQVLMMRTTWALCEALTLATGPISTLWEGNPGRFWNTTIAVSMANIFRGSYLAGAGLLFSIMKNTANTRRGTGNTGETLGEKWKNRLNALGKSEFQIYKKSGIQEVDRTLAKEGIKRGETDHHAVSRGSAKLRWFVERNLVTPEGKVVDLGCGRGGWSYYCGGLKNVKEVKGLTKGGPGHEEPIPMSTYGWNLVRLQSGVDVFFTPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESETPNLDIIGKRIEKIKQEHETSWHYDQDHPYKTWAYHGSYETKQTGSASSMVNGVVRLLTKPWDVIPMVTQMAMTDTTPFGQQRVFKEKVDTRTQEPKEGTKKLMKITAEWLWKELGKKKTPRMCTREEFTRKVRSNAALGAIFTDENKWKSAREAVEDSGFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVVTYGLNTFTNMEAQLIRQMEGEGVFKSIQQLTVKEEIAVKNWLIRVGRERLSRMAISGDDCVVKPLDDRFASALTALNDMGKVRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWIPTSRTTWSIHATHEWMTTEDMLTVWNRVWIQENPWMEDKTPVESWEEIPYLGKREDQWCGSLIGLTSRATWAKNIQTAINQVRSLIGNEEYTDYMPSMKRFRREEEEAGVLW

SEQ ID NO: 3777 - protein, 3291 aa, Artificial Sequence
  derived and/or modified protein sequence (wt) from DENV-2__KX380813__SS-prME
TAGIIIMMIPTVMAFHLTTRNGEPHMIVSRQEKGKSLLFKTENGVNMCTLMAMDLGELCEDTITYNCPLLRQNEPEDIDCWCNSTSTWVTYGTCTATGEHRREKRSVALVPHVGMGLETRTETWMSSEGAWKHAQRIETWILRHPGFTIMAAILAYTIGTTYFQRVLIFILLTAVTPSMAMRCIGISNRDFVEGVSGGSWVDIVLEHGSCVTTMAKNKPTLDFELIKTEAKHLATLRKYCVEAKLTNTTTASRCPTQGEPSLNEEQDKRFVCKHSMVDRGWGNGCGLFGKGGIVTCAMFTCKKNMEGKVVQPENLEYTIVITPHSGEENAVGNDTGKHGKEIKVTPQSSITEAELTGYGTVTMECSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKESAETQHGTIVIRVQYEGDGSPCKIPFEIMDLEKRHVLGRLITVNPIVTEKDSPVNIEAEPPFGDSYIIIGVEPGQLKLSWFKKGSSIGQMFETTMRGAKRMAILGDTAWDFGSLGGVFTSIGKALHQVFGAIYGAAFSGVSWTMKILIGVVITWIGMNSRSTSLSVSLVLVGVVTLYLGVMVQADSGCVVSWKNKELKCGSGIFITDNVHTWTEQYKFQPESPSKLASAIQKAHEEGICGIRSVTRLENLMWKQITPELNHILTENEVKLTIMTGDIKGIMQAGKRTLRPQPTELKYSWKAWGKAKMLSTELHNHTFLIDGPETAECPNTNRAWNSLEVEDYGFGVFTTNIWLKLKERQDVFCDSKLMSAAIKDNRAVHADMGYWIESALNDTWKIEKASFIEVKSCHWPKSHTLWSNGVLESEMIIPKNFAGPVSQHNYRPGYHTQTAGPWHLGRLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKIRPTFAAGLLLRKLTSKELMMTTIGIVLLSQSTIPESILELTDALALGMMVLKIVRNMEKYQLAVTIMAILCVPNAVILQNAWKVSCTTLAVVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVRWEEQAEISGSSPILSITISEDGSMSIKNEEEEQTLTILIRTGLLVISGLFPVSIPITAAAWYLWEVKKQRAGVLWDVPSPPPVGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIVDKKGKVVGLYGNGVVTRSGTYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPIRVPNYNLIIMDEAHFTDPASIAARGYISTRVEMGEAAGIFMTATPPGSRDPFPQSNAPIMDEEKEIPERSWNSGHEWVTDFKGKTVWFVPSIKAGNDIAACLRKNGKKVIQLSRKTFDSEYIKTRTNDWDFVVTTDISEMGANFKAERVIDPRRCMKPVILTDGEERVILAGPMPVTHSSAAQRRGRVGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGVKNNQILEENVEVEIWTKEGERKKLKPRWLDARIYSDPLALKEFKEFAAGRKSLTLNLITEMGRLPTFMTQKAKNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDFGLGSITTQQPESNILDIDLRPASAWTLYAVATTFITPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGMTVIDLDPIPYDPKFEKQLGQVMLLVLCVTQVLMMRTTWALCEALTLATGPISTLWEGNPGRFWNTTIAVSMANIFRGSYLAGAGLLFSIMKNTANTRRGTGNTGETLGEKWKNRLNALGKSEFQIYKKSGIQEVDRTLAKEGIKRGETDHHAVSRGSAKLRWFVERNLVTPEGKVVDLGCGRGGWSYYCGGLKNVKEVKGLTKGGPGHEEPIPMSTYGWNLVRLQSGVDVFFTSPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESETPNLDIIGKRIEKIKQEHETSWHYDQDHPYKTWAYHGSYETKQTGSASSMVNGVVRLLTKPWDVIPMVTQMAMTDTTPFGQQRVFKEKVDTRTQEPKEGTKKLMKITAEWLWKELGKKKTPRMCTREEFTRKVRSNAALGAIFTDENKWKSAREAVEDSGFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVVTYGLNTFTNMEAQLIRQMEGEGVFKSIQQLTVKEEIAVKNWLIRVGRERLSRMAISGDDCVVKPLDDRFASALTALNDMGKVRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWIPTSRTTWSIHATHEWMTTEDMLTVWNRVWIQENPWMEDKTPVESWEEIPYLGKREDQWCGSLIGLTSRATWAKNIQTAINQVRSLIGNEEYTDYMPSMKRFRREEEEAGVLW

SEQ ID NO: 3778 - protein, 3291 aa, Artificial Sequence
  derived and/or modified protein sequence (wt) from DENV-2__KX380814__SS-prME
TAGIIIMMIPTVMAFHLTTRNGEPHMIVSRQEKGKSLLFKTENGVNMCTLMAMDLGELCEDTITYNCPLLRQNEPEDIDCWCNSTSTWVTYGTCTATGEHRREKRSVALVPHVGMGLETRTETWMSSEGAWKHAQRIETWILRHPGFTIMAAILAYTIGTTYFQRVLIFILLTAVTPSMAMRCIGISNRDFVEGVSGGSWVDIVLEHGSCVTTMAKNKPTLDFELIKTEAKHLATLRKYCVEAKLTNTTTASRCPTQGEPSLNEEQDKRFVCKHSMVDRGWGNGCGLFGKGGIVTCAMFTCKKNMEGKVVQPENLEYTIVITPHSGEENAVGNDTGKHGKEIKVTPQSSITEAELTGYGTVTMECSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRHVLGRLITVNPIVTEKDSPVNIEAEPPFGDSYIIIGVEPGQLKLSWFKKGSSIGQMFETTMRGAKRMAILGDTAWDFGSLGGVFTSIGKALHQVFGAIYGAAFSGVSWTMKILIGVVITWIGMNSRSTSLSVSLVLVGVVTLYLGVMVQADSGCVVSWKNKELKCGSGIFITDNVHTWTEQYKFQPESPSKLASAIQKAHEEGICGIRSVTRLENLMWKQITPELNHILTENEVKLTIMTGDIKGIMQAGKRTLRPQPTELKYSWKAWGKAKMLSTELHNHTFLIDGPETAECPNTNRAWNSLEVEDYGFGVFTTNIWLKLKERQDVFCDSKLMSAAIKDNRAVHADMGYWIESALNDTWKIEKASFIEVKSCHWPKSHTLWSNGVLESEMIIPKNFAGPVSQHNYRPGYHTQTAGPWHLGRLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKIRPTFAAGLLLRKLTSKELMMTTIGIVLLSQSTIPESILELTDALALGMMVLKIVRNMEKYQLAVTIMAILCVPNAVILQNAWKVSCTTLAVVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVRWEEQAEISGSSPILSITISEDGSMSIKNEEEEQTLTILIRTGLLVISGLFPVSIPITAAAWYLWEVKKQRAGVLWDVPSPPPVGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIVDKKGKVVGLYGNGVVTRSGTYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPIRVPNYNLIIMDEAHFTDPASIAARGYISTRVEMGEAAGIFMTATPPGSRDPFPQSNAPIMDEEKEIPERSWNSGHEWVTDFKGKTVWFVPSIKAGNDIAACLRKNGKKVIQLSRKTFDSEYIKTRTNDWDFVVTTDISEMGANFKAERVIDPRRCMKPVILTDGEERVILAGPMPVTHSSAAQRRGRVGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGVKNNQILEENVEVEIWTKEGERKKLKPRWLDARIYSDPLALKEFKEFAAGRKSLTLNLITEMGRLPTFMTQKAKNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDFGLGSITTQQPESNILDIDLRPASAWTLYAVATTFITPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGMTVIDLDPIPYDPKFEKQLGQVMLLVLCVTQVLMMRTTWALCEALTLATGPISTLWEGNPGRFWNTTIAVSMANIFRGSYLAGAGLLFSIMKNTANTRRGTGNTGETLGEKWKNRLNALGKSEFQIYKKSGIQEVDRTLAKEGIKRGETDHHAVSRGSAKLRWFVERNLVTPEGKVVDLGCGRGGWSYYCGGLKNVKEVKGLTKGGPGHEEPIPMSTYGWNLVRLQSGVDVFFTSPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESETPNLDIIGKRIEKIKQEHETSWHYDQDHPYKTWAYHGSYETKQTGSASSMVNGVVRLLTKPWDVIPMVTQMAMTDTTPFGQQRVFKEKVDTRTQEPKEGTKKLMKITAEWLWKELGKKKTPRMCTREEFTRKVRSNAALGAIFTDENKWKSAREAVEDSGFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVVTYGLNTFTNMEAQLIRQMEGEGVFKSIQQLTVKEEIAVKNWLIRVGRERLSRMAISGDDCVVKPLDDRFASALTALNDMGKVRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWIPTSRTTWSIHATHEWMTTEDMLTVWNRVWIQENPWMEDKTPVESWEEIPYLGKREDQWCGSLIGLTSRATWAKNIQTAINQVRSLIGNEEYTDYMPSMKRFRREEEEAGVLW

SEQ ID NO: 3779 - protein, 3291 aa, Artificial Sequence
  derived and/or modified protein sequence (wt) from DENV-2__KX380807__SS-prME
TAGIIIMMIPTVMAFHLTTRNGEPHMIVSRQEKGKSLLFKTENGVNMCTLMAMDLGELCEDTITYNCPLLRQNEPEDIDCWCNSTSTWVTYGTCTATGEHRREKRSVALAPHVGMGLETRTETWMSSEGAWKHAQRIEIWVLRHPGFTIMAAILAYTIGTTYFQRVLIFILLTAVAPSMTMRCIGISNRDFVEGVSGGSWVDIVLEHGSCVTTMAKNKPTLDFELIKTEAKHPATLRKYCIEAKLTNTTTASRCPTQGEPSLNEEQDKRFVCKHSMVDRGWGNGCGLFGKGGIVTCAMFTCKKNMEGKIVQPENLEYTIVITPHSGEENAVGNDTGKHGKEIKVTPQSSITEAELTGYGTVTMECSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRHVLGRLITVNPIVTEKDSPVNIEAEPPFGDSYIIIGVEPGQLKLSWFKKGSSIGQMFETTMRGAKRMAILGDTAWDFGSLGGVFTSIGKALHQVFGAIYGAAFSGVSWTMKILIGVVITWIGMNSRSTSLSVSLVLVGVVTLYLGVMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKAWGKAKMLSTELHNHTFLIDGPETAECPNTNRAWNSLEVEDYGFGVFTTNIWLKLKERQDVFCDSKLMSAAIKDNRAVHADMGYWIESALNDTWKIEKASFIEVKSCHWPKSHTLWSNGVLESEMIIPKNFAGPVSQHNYRPGYHTQTAGPWHLGRLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDNIGMGVTYLALLAAFKVRPTFAAGLLLRKLTSKELMMTTIGIVLLSQSTIPETILELTDALALGMMVLKIVRNMEKYQLAVTIMAILCVPNAVILQNAWKVSCTILAVVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVRWEEQAEISGSSPILSITISEDGSMSIKNEEEEQTLTILIRTGLLVISGLFPVSIPITAAAWYLWEVKKQRAGVLWDVPSPPPVGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIVDKKGKVVGLYGNGVVTRSGTYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPIRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYIKTRTNDWDFVVTTDISEMGANFKAERVIDPRRCMKPVILTDGEERVILAGPMPVTHSSAAQRRGRVGRNPKNENDQYIYMGEPLENDEDCAHWKEAKMLLDNINTPEGIIPSMFEPEREKVDAVDGEYRLRGEARKTFVDLMRRGDLPVWLAYKVAAEGINYADRRWCFDGVKNNQILEENVEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDFGLGSITTQQPESNILDIDLRPASAWTLYAVATTFITPMLRHSIENSSVNVSLTAIANQATVLMGLGKGWPLSKMDIGVPLLAIGCYSQVNPITLTAALLLLVAHYAIIGPGLQAKATREAQKRTAAGIMKIPAALIVTVIDLDPIPYDPKFEKQLGQVMLLVLCSTQVLMMRTTWALCEALTLATGPISTLWEGNPGRFWNTTIAVSMANIFRGSYLAGAGLLFSIMKNTANTRRGTGNTGETLGEKWKNRLNALGKSEFQIYKKSGIQEVDRTLAKEGIKRGETDHHAVSRGSAKLRWFVERNLVTPEGKVVDLGCGRGGWSYYCGGLKNVKEVKGLTKGGPGHEEPIPMSTYGWNLVRLQSGVDVFFTPPEKCDTLLCDIGESSPNPTVEAGRTLRVLTLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESETPNLDIIGKRIEKIKQEHETSWHYDQDHPYKTWAYHGSYETKQTGSASSMVNGVVRLLTKPWDVIPMVTQMAMTDTTPFGQQRVFKEKVDTRTQEPKEGTKKLMKITAEWLWKELGKKKTPRMCTREEFTRKVRSNAALGAIFTDENKWKSAREAVEDSGFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVVTYGLNTFTNMEAQLIRQMEGEGVFKSIQQLTATEEIAVKNWLVRVGRERLSRMAISGDDCVVKPLDDRFASALTALNDMGKVRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHATHEWMTTEDMLTVWNRVWIQENPWMEDKTPVESWEEIPYLGKREDQWCGSLIGLTSRATWAKNIQTAINQVRSLIGNEEYTDYMPSMKRFRREEEEAGVLW

SEQ ID NO: 3780 - protein, 3291 aa, Artificial Sequence
  derived and/or modified protein sequence (wt) from DENV-2__KX380815__SS-prME
TAGIIIMMIPTVMAFHLTTRNGEPHMIVSRQEKGKSLLFKTENGVNMCTLMAMDLGELCEDTITYNCPLLRQNEPEDIDCWCNSTSTWVTYGTCTATGEHRREKRSVALVPHVGMGLETRTETWMSSEGAWKHAQRIETWVLRHPGFTIMAAILAYTIGTTYFQRVLIFILLTAVAPSMTMRCIGISNRDFVEGVSGGSWVDIVLEHGSCVTTMAKNKPTLDFELIKTEAKHPATLRKYCIEAKLTNTTTASRCPTQGEPSLNEEQDKRFVCKHSMVDRGWGNGCGLFGKGGIVTCAMFTCKKNMEGKIVQPENLEYTIVITPHSGEENAVGNDTGKHGKEIKVTPQSSITEAELTGYGTVTMECSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRHVLGRLITVNPIVTEKDSPVNIEAEPPFGDSYIIIGVEPGQLKLSWFKKGSSIGQMFETTMRGAKRMAILGDTAWDFGSLGGVFTSIGKALHQVFGAIYGAAFSGVSWTMKILIGVVITWIGMNSRSTSLSVSLVLVGVVTLYLGVMVQADSGCVVSWKNKELKCGSGIFITDNVHTWTEQYKFQPESPSKLASAIQKAHEEGICGIRSVTRLENLMWKQITPELNHILTENEVKLTIMTGDIKGIMQAGKRSLRPQPTELKYSWKAWGKAKMLSTELHNHTFLIDGPETAECPNTNRAWNSLEVEDYGFGVFTTNIWLKLKERQDVSCDSKLMSAAIKDNRAVHADMGYWIESALNDTWKIEKASFIEVKSCHWPKSHTLWSNGVLESEMIIPKNFAGPVSQHNYRPGYHTQTAGPWHLGRLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMTTIGIVLLSQSTIPETILELTDALALGMMVLKIVRNMEKYQLAVTIMAILCVPNAVILQNAWKVSCTTLAVVSVSPLLLTSSQQKTDWIPLALTIKGLNPTAIFLTTLSRTSKKRSWPLNEAIMAVGMVSILASSFLKNDIPMTGPLVAGGLLTVCYVLTGRSADLELERAADIRWEEQAEISGSSPILSITISEDGSMSIKNEEEEQTLTILIRTGLLVISGLFPVSIPITAAAWYLWEVKKQRAGVLWDVPSPPPVGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIVDKKGKVVGLYGNGVVTRSGTYVSAIAQTEKNIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPIRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRVGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGVKNNQILEENVEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIVTASILLWYAQIQPHWIAASIILEFFLIVLLIPEPEKQRTPQDNQLTYVVIAILTVVAATMANEMGFLEKTKKDFGLGSITTQQPESNILDIDLRPASAWTLYAVATTFITPMLRHSIENSSVNVSLTAIANQATVLMGLGKGWPLSKMDIGVPLLAIGCYSQVNPITLTAALLLLVAHYAIIGPGLQAKATREAQKRAAAGIMKIPAALIMTVIDLDPIPYDPKFEKQLGQVMLLVLCSTQVLMMRTTWALCEALTLATGPISTLWEGNPGRFWNTTIAVSMANIFRGSYLAGAGLLFSIMKNTANTRRGTGNTGETLGEKWKNQLNALGKSEFQIYKKSGIQEVDRTLAKEGIKRGETDHHAVSRGSAKLRWFVERNLVTPEGKVVDLGCGRGGWSYYCGGLKNVKEVKGLTKGGPGHEEPIPMSTYGWNLVRLQSGVDVFFTPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESEVPNLDIIGKRIEKIKQEHETSWHYDQDHPYKTWAYHGSYETKQTGSASSMVNGVVRLLTKPWDVIPMVTQMAMTDTTPFGQQRVFKEKVDTRTQEPKEGTKKLMKITAEWLWKELGKKKTPRMCTREEFTRKVRSNAALGAIFTDENKWKSAREAVEDSGFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFRLTYQNKVVRVQRPTPRGTVMDIISRRDQRGSGQVVTYGLNTFTNMEAQLIRQMEGEGVFKSIQHLTATEEIAVKNWLVRVGRERLSRMAISGDDCVVKPLDDRFANALTALNDMGKVRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHATHEWMTTEDMLTVWNRVWIQENPWMEDKTPVESWEEIPYLGKREDQWCGSLIGLTSRATWAKNIQTAINQVRSLIGNEEYTDYMPSMKRFRREEEEAGVLW

SEQ ID NO: 3781 - protein, 3291 aa, Artificial Sequence
  derived and/or modified protein sequence (wt) from DENV-2__KX380816__SS-prME
TAGIIIMMIPTVMAFHLTTRNGEPHMIVSRQEKGKSLLFKTENGVNMCTLMAMDLGELCEDTITYNCPLLRQNEPEDIDCWCNSTSTWVTYGTCTATGEHRREKRSVALVPHVGMGLETRTETWMSSEGAWKHAQRIETWILRHPGFTIMAAILAYTIGTTYFQRVLIFILLTAVTPSMAMRCIGISNRDFVEGVSGGSWVDIVLEHGSCVTTMAKNKPTLDFELIKTEAKHLATLRKYCVEAKLTNTTTASRCPTQGEPSLNEEQDKRFVCKHSMVDRGWGNGCGLFGKGGIVTCAMFTCKKNMEGKVVQPENLEYTIVITPHSGEENAVGNDTGKHGKEIKVTPQSSITEAELTGYGTVTMECSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRHVLGRLITVNPIVTEKDSPVNIEAEPPFGDSYIIIGVEPGQLKLSWFKKGSSIGQMFETTMRGAKRMAILGDTAWDFGSLGGVFTSIGKALHQVFGAIYGAAFSGVSWTMKILIGVVITWIGMNSRSTSLSVSLVLVGVVTLYLGVMVQADSGCVVSWKNKELKCGSGIFITDNVHTWTEQYKFQPESPSKLASAIQKAHEEGICGIRSVTRLENLMWKQITPELNHILTENEVKLTIMTGDIKGIMQAGKRTLRPQPTELKYSWKAWGKAKMLSTELHNHTFLIDGPETAECPNTNRAWNSLEVEDYGFGVFTTNIWLKLKERQDVFCDSKLMSAAIKDNRAVHADMGYWIESALNDTWKIEKASFIEVKSCHWPKSHTLWSNGVLESEMIIPKNFAGPVSQHNYRPGYHTQTAGPWHLGRLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKIRPTFAAGLLLRKLTSKELMMTTIGIVLLSQSTIPESILELTDALALGMMVLKIVRNMEKYQLAVTIMAILCVPNAVILQNAWKVSCTTLAVVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVRWEEQAEISGSSPILSITISEDGSMSIKNEEEEQTLTILIRTGLLVISGLFPVSIPITAAAWYLWEVKKQRAGVLWDVPSPPPVGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIVDKKGKVVGLYGNGVVTRSGTYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPIRVPNYNLIIMDEAHFTDPASIAARGYISTRVEMGEAAGIFMTATPPGSRDPFPQSNAPIMDEEKEIPERSWNSGHEWVTDFKGKTVWFVPSIKAGNDIAACLRKNGKKVIQLSRKTFDSEYIKTRTNDWDFVVTTDISEMGANFKAERVIDPRRCMKPVILTDGEERVILAGPMPVTHSSAAQRRGRVGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGVKNNQILEENVEVEIWTKEGERKKLKPRWLDARIYSDPLALKEFKEFAAGRKSLTLNLITEMGRLPTFMTQKAKNALDNLAVLHTAEAGGRAYNHALSELPETLETLLLLTLLATVTGGIFLFLMSGKGIGKMTLGMCCIITASILLWHAQIQPHWIAASIILEFFLIVLLIPEPEKQRTPQDNQLTYVVIAILTVVAATMANEMGFLEKTKKDFGLGSITTQQPESNILDIDLRPASAWTLYAVATTFITPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGMTVIDLDPIPYDPKFEKQLGQVMLLVLCVTQVLMMRTTWALCEALTLATGPISTLWEGNPGRFWNTTIAVSMANIFRGSYLAGAGLLFSIMKNTANTRRGTGNTGETLGEKWKNRLNALGKSEFQIYKKSGIQEVDRTLAKEGIKRGETDHHAVSRGSAKLRWFVERNLVTPEGKVVDLGCGRGGWSYYCGGLKNVKEVKGLTKGGPGHEEPIPMSTYGWNLVRLQSGVDVFFTSPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESETPNLDIIGKRIEKIKQEHETSWHYDQDHPYKTWAYHGSYETKQTGSASSMVNGVVRLLTKPWDVIPMVTQMAMTDTTPFGQQRVFKEKVDTRTQEPKEGTKKLMKITAEWLWKELGKKKTPRMCTREEFTRKVRSNAALGAIFTDENKWKSAREAVEDSGFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVVTYGLNTFTNMEAQLIRQMEGEGVFKSIQQLTVKEEIAVKNWLIRVGRERLSRMAISGDDCVVKPLDDRFASALTALNDMGKVRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWIPTSRTTWSIHATHEWMTTEDMLTVWNRVWIQENPWMEDKTPVESWEEIPYLGKREDQWCGSLIGLTSRATWAKNIQTAINQVRSLIGNEEYTDYMPSMKRFRREEEEAGVLW

SEQ ID NO: 3782 - protein, 3291 aa, Artificial Sequence
  derived and/or modified protein sequence (wt) from DENV-2__KX380817__SS-prME
TAGIIIMMIPTVMAFHLTTRNGEPHMIVSRQEKGKSLLFKTENGVNMCTLMAMDLGELCEDTITYNCPLLRQNEPEDIDCWCNSTSTWVTYGTCTATGEHRREKRSVALVPHVGMGLETRTETWMSSEGAWKHAQRIETWILRHPGFTIMAAILAYTIGTTYFQRVLIFILLTAVTPSMAMRCIGISNRDFVEGVSGGSWVDIVLEHGSCVTTMAKNKPTLDFELIKTEAKHLATLRKYCVEAKLTNTTTASRCPTQGEPSLNEEQDKRFVCKHSMVDRGWGNGCGLFGKGGIVTCAMFTCKKNMEGKVVQPENLEYTIVITPHSGEENAVGNDTGKHGKEIKITPQSSITEAELTGYGTVTMECSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRHVLGRLITVNPIVTEKDSPVNIEAEPPFGDSYIIIGVEPGQLKLSWFKKGSSIGQMFETTMRGAKRMAILGDTAWDFGSLGGVFTSIGKALHQVFGAIYGAAFSGVSWTMKILIGVVITWIGMNSRSTSLSVSLVLVGVVTLYLGVMVQADSGCVVSWKNKELKCGSGIFITDNVHTWTEQYKFQPESPSKLASAIQKAHEEGICGIRSVTRLENLMWKQITPELNHILTENEVKLTIMTGDIKGIMQAGKRSLRPQPTELKYSWKAWGKAKMLSTELHNHTFLIDGPETAECPNTNRAWNSLEVEDYGFGVFTTNIWLKLKERQDVFCDSKLMSAAIKDNRAVHADMGYWIESALNDTWKIEKASFIEVKSCHWPKSHTLWSNGVLESEMIIPKNFAGPVSQHNYRPGYHTQTAGPWHLGRLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMTTIGIVLLSQSTIPESILELTDALALGMMVLKIVRNMEKYQLAVTIMAISCVPNAVILQNAWKVSCTTLAVVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVRWEEQAEISGSSPILSITISEDGSMSIKNEEEEQTLTILIRTGLLVISGLFPVSIPITAAAWYLWEVKKQRAGVLWDVPSPPPVGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIVDKKGKVVGLYGNGVVTRSGTYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPIRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYIKTRTNDWDFVVTTDISEMGANFKAERVIDPRRCMKPVILTDGEERVILAGPMPVTHSSAAQRRGRVGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGVKNNQILEENVEVEIWTKEGERKKLKPRWLDARIYSDPLALKEFKEFAAGRKSLTLNLITEMGRLPTFMTQKAKNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDFGLGSITTQQPESNILDIDLRPASAWTLYAVATTFITPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGMTVIDLDPIPYDPKFEKQLGQVMLLVLCVTQVLMMRTTWALCEALTLATGPISTLWEGNPGRFWNTTIAVSMANIFRGSYLAGAGLLFSIMKNTANTRRGTGNTGETLGEKWKNRLNALGKSEFQIYKKSGIQEVDRTLAKEGIKRGETDHHAVSRGSAKLRWFVERNLVTPEGKVVDLGCGRGGWSYYCGGLKNVKEVKGLTKGGPGHEEPIPMSTYGWNLVRLQSGVDVFFTPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESETPNLDIIGKRIEKIKQEHETSWHYDQDHPYKTWAYHGSYETKQTGSASSMVNGVVRLLTKPWDVIPMVTQMAMTDTTPFGQQRVFKEKVDTRTQEPKEGTKKLMKITAEWLWKELGKKKTPRMCTREEFTRKVRSNAALGAIFTDENKWKSAREAVEDSGFWELVDRERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVVTYGLNTFTNMEAQLIRQMEGEGVFKSIQQLTVKEEIAVKNWLIRVGRERLSRMAISGDDCVVKPLDDRFASALTALNDMGKVRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWIPTSRTTWSIHATHEWMTTEDMLTVWNRVWIQENPWMEDKTPVESWEEIPYLGKREDQWCGSLIGLTSRATWAKNIQTAINQVRSLIGNEEYTDYMPSMKRFRREEEEAGVLW

SEQ ID NO: 3783 - protein, 3291 aa, Artificial Sequence
  derived and/or modified protein sequence (wt) from DENV-2__KX380818__SS-prME
TAGIIIMMIPTVMAFHLTTRNGEPHMIVSRQEKGKSLLFKTENGVNMCTLMAMDLGELCEDTITYNCPLLRQNEPEDIDCWCNSTSTWVTYGTCTATGEHRREKRSVALVPHVGMGLETRTETWMSSEGAWKHAQRIETWVLRHPGFTIMAAILAYTIGTTYFQRVLIFILLTAVAPSMTMRCIGISNRDFVEGVSGGSWVDIVLEHGSCVTTMAKNKPTLDFELIKTEAKHPATLRKYCIEAKLTNTTTASRCPTQGEPSLNEEQDKRFVCKHSMVDRGWGNGCGLFGKGGIVTCAMFTCKKNMEGKIVQPENLEYTIVITPHSGEENAVGNDTGKHGKEIKVTPQSSITEAELTGYGTVTMECSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRHVLGRLITVNPIVTEKDSPVNIEAEPPFGDSYIIIGVEPGQLKLSWFKKGSSIGQMFETTMRGAKRMAILGDTAWDFGSLGGVFTSIGKALHQVFGAIYGAAFSGVSWTMKILIGVVITWIGMNSRSTSLSVSLVLVGVVTLYLGVMVQADSGCVVSWKNKELKCGSGIFITDNVHTWTEQYKFQPESPSKLASAIQKAHEEGICGIRSVTRLENLMWKQITPELNHILTENEVKLTIMTGDIKGIMQAGKRSLRPQPTELKYSWKAWGKAKMLSTELHNHTFLIDGPETAECPNTNRAWNSLEVEDYGFGVFTTNIWLKLKERQDVSCDSKLMSAAIKDNRAVHADMGYWIESALNDTWKIEKASFIEVKSCHWPKSHTLWSNGVLESEMIIPKNFAGPVSQHNYRPGYHTQTAGPWHLGRLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMTTIGIVLLSQSTIPETILELTDALALGMMVLKIVRNMEKYQLAVTIMAILCVPNAVILQNAWKVSCTTLAVVSVSPLLLTSSQQKTDWIPLALTIKGLNPTAIFLTTLSRTSKKRSWPLNEAIMAVGMVSILASSFLKNDIPMTGPLVAGGLLTVCYVLTGRSADLELERAADIRWEEQAEISGSSPILSITISEDGSMSIKNEEEEQTLTILIRTGLLVISGLFPVSIPITAAAWYLWEVKKQRAGVLWDVPSPPPVGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIVDKKGKVVGLYGNGVVTRSGTYVSAIAQTEKNIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPIRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRVGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGVKNNQILEENVEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIVTASILLWYAQIQPHWIAASIILEFFLIVLLIPEPEKQRTPQDNQLTYVVIAILTVVAATMANEMGFLEKTKKDFGLGSITTQQPESNILDIDLRPASAWTLYAVATTFITPMLRHSIENSSVNVSLTAIANQATVLMGLGKGWPLSKMDIGVPLLAIGCYSQVNPITLTAALLLLVAHYAIIGPGLQAKATREAQKRAAAGIMKIPAADIGRVIDLDPIPYDPKFEKQLGQVMLLVLCVTQVLMMRTTWALCEALTLATGPISTLWEGNPGRFWNTTIAVSMANIFRGSYLAGAGLLFSIMKNTANTRRGTGNTGETLGEKWKNQLNALGKSEFQIYKKSGIQEVDRTLAKEGIKRGETDHHAVSRGSAKLRWFVERNLVTPEGKVVDLGCGRGGWSYYCGGLKNVKEVKGLTKGGPGHEEPIPMSTYGWNLVRLQSGVDVFFTPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESEVPNLDIIGKRIEKIKQEHETSWHYDQDHPYKTWAYHGSYETKQTGSASSMVNGVVRLLTKPWDVIPMVTQMAMTDTTPFGQQRVFKEKVDTRTQEPKEGTKKLMKITAEWLWKELGKKKTPRMCTREEFTRKVRSNAALGAIFTDENKWKSAREAVEDSGFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFRLTYQNKVVRVQRPTPRGTVMDIISRRDQRGSGQVVTYGLNTFTNMEAQLIRQMEGEGVFKSIQHLTATEEIAVKNWLVRVGRERLSRMAISGDDCVVKPLDDRFANALTALNDMGKVRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHATHEWMTTEDMLTVWNRVWIQENPWMEDKTPVESWEEIPYLGKREDQWCGSLIGLTSRATWAKNIQTAINQVRSLIGNEEYTDYMPSMKRFRREEEEAGVLW

SEQ ID NO: 3784 - protein, 3291 aa, Artificial Sequence
  derived and/or modified protein sequence (wt) from DENV-2__KX380819__SS-prME
TAGIIIMMIPTVMAFHLTTRNGEPHMIVSRQEKGKSLLFKTENGVNMCTLMAMDLGELCEDTITYNCPLLRQNEPEDIDCWCNSTSTWVTYGTCTATGEHRREKRSVALVPHVGMGLETRTETWMSSEGAWKHAQRIETWVLRHPGFTVMAAILAYTIGTTYFQRVLIFILLTAVAPSMTMRCIGISNRDFVEGISGGSWVDIVLEHGSCVTTMAKNKPTLDFELIKTEAKHPATLRKYCIEAKLTNTTTASRCPTQGEPSLNEEQDKRFVCKHSMVDRGWGNGCGLFGKGGIVTCAMFTCKKNMEGKIVQPENLEYTIVITPHSGEENAVGNDTGKHGKEIKVTPQSSITEAELTGYGTATMECSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRHVLGRLITVNPIVTEKDSPVNIEAEPPFGDSYIIIGVEPGQLKLSWFKKGSSIGQMFETTMRGAKRMAILGDTAWDFGSLGGVFTSIGKALHQVFGAIYGAAFSGVSWTMKILIGVVITWIGMNSRSTSLSVSLVLVGIVTLYLGVMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKAWGKAKMLSTELHNHTFLIDGPETAECPNTNRAWNSLEVEDYGFGVFTTNIWLKLKERQDVFCDSKLMSAAIKDNRAVHADMGYWIESALNDTWKIEKASFIEVKSCHWPKSHTLWSNGVLESEMIIPKNFAGPVSQHNYRPGYHTQTAGPWHLGRLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMTTIGIVLLSQSTIPETILELTDALALGMMVLKIVRNMEKYQLAVTIMAILCVPNAVILQNAWKVSCTILAVVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVRWEEQAEISGSSPILSITISEDGSMSIKNEEEEQTLTILIRTGLLVISGLFPVSIPITAAAWYLWEVKKQRAGVLWDVPSPPPVGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIVDKKGKVVGLYGNGVVTRSGTYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPIRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYIKTRTNDWDFVVTTDISEMGANFKAERVIDPRRCMKPVILTDGEERVILAGPMPVTHSSAAQRRGRVGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGVKNNQILEENVEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDFGLGSITTQQPDSNILDIDLRPASAWTLYAVATTFITPMLRHSIENSSVNVSLTAIANQATVLMGLGKGWPLSKMDIGVPLLAIGCYSQVNPITLTAALLLLVAHYAIIGPGLQAKATREAQKRAAAGIMKIPAALIGRVIDLDPIPYDPKFEKQLGQVMLLVLCVTQVLMMRTTWALCEALTLATGPISTLWEGNPGRFWNTTIAVSMANIFRGSYLAGAGLLFSIMKNTANTRRGTGNTGETLGEKWKNRLNALGKSEFQIYKKSGIQEVDRTLAKEGIKRGETDHHAVSRGSAKLRWFVERNLVTPEGKVVDLGCGRGGWSYYCGGLKNVKEVKGLTKGGPGHEEPIPMSTYGWNLVRLQSGVDVFFTPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMKHKKATYEPDVDLGSGTRNIGIESETPNLDIIGKRIEKIKQEHETSWHYDQDHPYKTWAYHGSYETKQTGSASSMVNGVVRLLTKPWDVIPMVTQMAMTDTTPFGQQRVFKEKVDTRTQEPKEGTKKLMKITAEWLWKELGKKKTPRMCTREEFTRKVRSNAALGAIFTDENKWKSAREAVEDSGFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHRKLAEAIFRLTYQNKVVRVQRPTPRGTVMDIISRRDQRGSGQVVTYGLNTFTNMEAQLIRQMEGEGVFKSIQHLTVTEEIAVKNWLERVGRERLSRMAISGDDCVVKPLDDRFASALTALNDMGKVRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWVPISRTTWSIHATHEWMTTEDMLTAWNRVWIQENPWMEDKTPVESWEEIPYLGKREDQWCGSLIGLTSRATWAKNIQTAINQVRSLIGNEEYTDYMPSMKRFRREEEEAGVLW

SEQ ID NO: 3785 - protein, 3291 aa, Artificial Sequence
  derived and/or modified protein sequence (wt) from DENV-2__KX380821__SS-prME
TAGIIIMMIPTVMAFHLTTRNGEPHMIVSRQEKGKSLLFKTENGVNMCTLMAMDLGELCEDTITYNCPLLRQNEPEDIDCWCNSTSTWVTYGTCTATGEHRREKRSVALVPHVGMGLETRTETWMSSEGAWKHAQRIETWVLRHPGFTVMAAILAYTIGTTYFQRVLIFILLTAVAPSMTMRCIGISNRDFVEGVSGGSWVDIVLEHGSCVTTMAKNKPTLDFELIKTEAKHPATLRKYCIEAKLTNTTTASRCPTQGEPSLNEEQDKRFVCKHSMVDRGWGNGCGLFGKGGIVTCAMFTCKKNMEGKIVQPENLEYTIVITPHSGEENAVGNDTGKHGKEIKVTPQSSITEAELTGYGTATMECSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRHVLGRLITVNPIVTEKDSPVNIEAEPPFGDSYIIIGVEPGQLKLSWFKKGSSIGQMFETTMRGAKRMAILGDTAWDFGSLGGVFTSIGKALHQVFGAIYGAAFSGVSWTMKILIGVVITWIGMNSRSTSLSVSLVLVGVVTLYLGVMVQADSGCVVSWKNKELKCGSGIFITDNVHTWTEQYKFQPESPSKLASAIQKAHEEGICGIRSVTRLENLMWKQITPELNHILTENEVKLTIMTGDIKGIMQAGKRTLRPQPTELKYSWKAWGKAKMLSTELHNHTFLIDGPETAECPNTNRAWNSLEVEDYGFGVFTTNIWLKLKERQDVFCDSKLMSAAIKDNRAVHADMGYWIESALNDTWKIEKASFIEVKSCHWPKSHTLWSNGVLESEMIIPKNFAGPVSQHNYRPGYHTQTAGPWHLGRLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKIRPTFAAGLLLRKLTSKELMMTTIGIVLLSQSTIPESILELTDALALGMMVLKIVRNMEKYQLAVTIMAILCVPNAVILQNAWKVSCTTLAVVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVRWEEQAEISGSSPILSITISEDGSMSIKNEEEEQTLTILIRTGLLVISGLFPVSIPITAAAWYLWEVKKQRAGVLWDVPSPPPVGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIVDKKGKVVGLYGNGVVTRSGTYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPIRVPNYNLIIMDEAHFTDPASIAARGYISTRVEMGEAAGIFMTATPPGSRDPFPQSNAPIMDEEKEIPERSWNSGHEWVTDFKGKTVWFVPSIKAGNDIAACLRKNGKKVIQLSRKTFDSEYIKTRTNDWDFVVTTDISEMGANFKAERVIDPRRCMKPVILTDGEERVILAGPMPVTHSSAAQRRGRVGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGVKNNQILEENVEVEIWTKEGERKKLKPRWLDARIYSDPLALKEFKEFAAGRKSLTLNLITEMGRLPTFMTQKAKNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDFGLGSITTQQPESNILDIDLRPASAWTLYAVATTFITPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGMTVIDLDPIPYDPKFEKQLGQVMLLVLCVTQVLMMRTTWALCEALTLATGPISTLWEGNPGRFWNTTIAVSMANIFRGSYLAGAGLLFSIMKNTANTRRGTGNTGETLGEKWKNRLNALGKSEFQIYKKSGIQEVDRTLAKEGIKRGETDHHAVSRGSAKLRWFVERNLVTPEGKVVDLGCGRGGWSYYCGGLKNVKEVKGLTKGGPGHEEPIPMSTYGWNLVRLQSGVDVFFTPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESETPNLDIIGKRIEKIKQEHETSWHYDQDHPYKTWAYHGSYETKQTGSASSMVNGVVRLLTKPWDVIPMVTQMAMTDTTPFGQQRVFKEKVDTRTQEPKEGTKKLMKITAEWLWKELGKKKTPRMCTREEFTRKVRSNAALGAIFTDENKWKSAREAVEDSGFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVVTYGLNTFTNMEAQLIRQMEGEGVFKSIQQLTVKEEIAVKNWLIRVGRERLSRMAISGDDCVVKPLDDRFASALTALNDMGKVRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWIPTSRTTWSIHATHEWMTTEDMLTVWNRVWIQENPWMEDKTPVESWEEIPYLGKREDQWCGSLIGLTSRATWAKNIQTAINQVRSLIGNEEYTDYMPSMKRFRREEEEAGVLW

SEQ ID NO: 3786 - protein, 3291 aa, Artificial Sequence
  derived and/or modified protein sequence (wt) from DENV-2__KX380822__SS-prME
TAGIIIMMIPTVMAFHLTTRNGEPHMIVSRQEKGKSLLFKTENGVNMCTLMAMDLGELCEDTITYNCPLLRQNEPEDIDCWCNSTSTWVTYGTCTATGEHRREKRSVALVPHVGMGLETRTETWMSSEGAWKHAQRIETWVLRHPGFTVMAAILAYTIGTTYFQRVLIFILLTAVAPSMTMRCIGISNRDFVEGVSGGSWVDIVLEHGSCVTTMAKNKPTLDFELIKTEAKHPATLRKYCIEAKLTNTTTASRCPTQGEPSLNEEQDKRFVCKHSMVDRGWGNGCGLFGKGGIVTCAMFTCKKNMEGKIVQPENLEYTIVITPHSGEENAVGNDTGKHGKEIKVTPQSSITEAELTGYGTATMECSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRHVLGRLITVNPIVTEKDSPVNIEAEPPFGDSYIIIGVEPGQLKLSWFKKGSSIGQMFETTMRGAKRMAILGDTAWDFGSLGGVFTSIGKALHQVFGAIYGAAFSGVSWTMKILIGVVITWIGMNSRSTSLSVSLVLVGIVTLYLGVMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKAWGKAKMLSTELHNHTFLIDGPETAECPNTNRAWNSLEVEDYGFGVFTTNIWLKLKERQDVFCDSKLMSAAIKDNRAVHADMGYWIESALNDTWKIEKASFIEVKSCHWPKSHTLWSNGVLESEMIIPKNFAGPVSQHNYRPGYHTQTAGPWHLGRLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMTTIGIVLLSQSTIPETILELTDALALGMMVLKIVRNMEKYQLAVTIMTILCVPNAVILQNAWKVSCTILAVVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVRWEEQAEISGSSPILSITISEDGSMSIKNEEEEQTLTILIRTGLLVISGLFPVSIPITAAAWYLWEVKKQRAGVLWDVPSPPPVGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIVDKKGKVVGLYGNGVVTRSGTYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPIRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDITACLRKNGKKVIQLSRKTFDSEYIKTRTNDWDFVVTTDISEMGANFKAERVIDPRRCMKPVILTDGEERVILAGPMPVTHSSAAQRRGRVGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGVKNNQILEENVEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDFGLGSITTQQPDSNILDIDLRPASAWTLYAVATTFITPMLRHSIENSSVNVSLTAIANQATVLMGLGKGWPLSKMDIGVPLLAIGCYSQVNPITLTAALLLLVAHYAIIGPGLQAKATREAQKRAAAGIMKIPAADGMTVIDLDPIPYDPKFEKQLGQVMLLVLCVTQVLMMRTTWALCEALTLATGPISTLWEGNPGRFWNTTIAVSMANIFRGSYLAGAGLLFSIMKNTANTRRGTGNTGETLGEKWKNRLNALGKSEFQIYKKSGIQEVDRTLAKEGIKRGETDHHAVSRGSAKLRWFVERNLVTPEGKVVDLGCGRGGWSYYCGGLKNVKEVKGLTKGGPGHEEPIPMSTYGWNLVRLQSGVDVFFTPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMKHKKATYEPDVDLGSGTRNIGIESETPNLDIIGKRIEKIKQEHETSWHYDQDHPYKTWAYHGSYETKQTGSASSMVNGVVRLLTKPWDVIPMVTQMAMTDTTPFGQQRVFKEKVDTRTQEPKEGTKKLMKITAEWLWKELGKKKTPRMCTREEFTRKVRSNAALGAIFTDENKWKSAREAVEDSGFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHRKLAEAIFRLTYQNKVVRVQRPTPRGTVMDIISRRDQRGSGQVVTYGLNTFTNMEAQLIRQMEGEGVFKSIQHLTVTEEIAVKNWLERVGRERLSRMAISGDDCVVKPLDDRFASALTALNDMGKVRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHATHEWMTTEDMLTVWNRVWIQENPWMEDKTPVESWEEIPYLGKREDQWCGSLIGLTSRATWAKNIQTAINQVRSLIGNEEYTDYMPSMKRFRREEEEAGVLW

SEQ ID NO: 3787 - protein, 3291 aa, Artificial Sequence
  derived and/or modified protein sequence (wt) from DENV-2__KX380828__SS-prME
TAGVIIMLIPTAMAFHLTTRNGEPHMIVSRQEKGKSLLFKTEDGVNMCTLMAMDLGELCEDTITYNCPLLRQNEPEDIDCWCNSTSTWVTYGTCTATGEHRREKRSVALVPHVGMGLETRTETWMSSEGAWKHAQRIETWILRHPGFTIMAAILAYTIGTTYFQRVLIFILLTAVAPSMTMRCIGISNRDFVEGVSGGSWVDIVLEHGSCVTTMAKNKPTLDFELIKTEAKQPATLRKYCIEAKLTNTTTASRCPTQGEPSLNEEQDKRFVCKHSMVDRGWGNGCGLFGKGGIVTCAMFTCKKNMEGKIVQPENLEYTIVVTPHSGEENAVGNDTGKHGKEIKVTPQSSITEAELTGYGTVTMECSPRTGLDFNEMVLLQMENKAWLVHRQWFLDLPLPWLPGADTQGSNWIQKEMLVTFKNPHAKKQDVVVLGSQEGAMHTALTGATEIQMSSGNLLFTGHLKCRLRMDKLQLKGMSYSMCTGKFKVVKEIAETQHGTIVVRVQYEGDGSPCKIPFEIMDLEKRHVLGRLITVNPIVTEKDSPVNIEAEPPFGDSYIIIGVEPGQLKLSWFKKGSSIGQMFETTMRGAKRMAILGDTAWDFGSLGGVFTSIGKALHQVFGAIYGAAFSGVSWTMKILIGVVITWIGMNSRSTSLSVSLVLVGVVTLYLGVMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTEPHNQTFLIDGPETAECPNTNRAWNSLEVEDYGFGVFTTNIWLKLKERQDVFCDSKLMSAAIKDNRAVHADMGYWIESALNDTWKIEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYKGEDGCWYGMEIRPLKEKEENLVNSLVTAGHGQIDNFSLGVLGMALFLEEMLRTRVGTKHAVLLVAVSFMTLITGNMSFRDLGRVMVMVGAAMTDDIGMGVTYLALLAAFKVRPTFAAGLLLRKLTSKELMMTTIGIVLLSQSTIPETILELTDALALGMMILKIVRNMEKYQLAVTIMAILCAPNAVILQNAWKVSCTILAVVSVSPLLLTSSQQKADWIPLALTIKGLNPTAIFLTTLSRTNKKRSWPLNEAIMAVGMVSILASSLLKNDIPMTGPLVAGGLLTVCYVLTGRSADLELERAADVRWEDQAEISGSSPILSITISEDGSMSIKNEEEEQTLTILIRTGLLVISGLFPVSIPITAAAWYLWEVKKQRAGVLWDVPSPPPVGKAELEDGAYRIKQKGILGYSQIGAGVYKEGTFHTMWHVTRGAVLMHKGKRIEPSWADVRKDLISYGGGWKLEGEWKEGEEVQVLALEPGKNPRAVQTKPGLFKTNTGTIGAVSLDFSPGTSGSPIVDKKGKVVGLYGNGVVTRSGTYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYIKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVELMRRGDLPVWLAYRVAAEGINYADRRWCFDGIKNNQILEENVEVEIWTKEGEKKKLKPRWLDARIYSDPLALKEFKEFAAGRKSLTMNLITEMGRLPTFMTQKARNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDFGLGSIVAQQPESNILDIDLRPASAWTLYAVATTFITPMLRHSIENSSVNVSLTAIANQATVLMGLGKGWPLSKMDIGVPLLAIGCYSQVNPITLTAALLLLVAHYAIIGPGLQAKATREAQKRAAAGIMKIPTVDGITVIDLDPIPYDPKFEKQLGQVMLLVLCVTQVLMMRTTWALCEALTLATGPISTLWEGNPGRFWNTTIAVSMANIFRGSYLAGAGLLFSIMKNTTNTRRGTGNTGETLGEKWKNRLNSLGKSEFQIYKRSGIQEVDRTLAKEGIKRGETDHHAVSRGSAKLRWFVERNLVTPEGKVMDLGCGRGGWSYYCGGLKNVREVKGLTKGGPGHEEPIPMSTYGWNLVRLQSGVDVFFTPPEKCDTLLCDIGESSPNPTVEAGRTLRVLNLVENWLNNNTQFCIKVLNPYMPSVIEKMETLQRKYGGALVRNPLSRNSTHEMYWVSNASGNIVSSVNMISRMLINRFTMRHKKATYEPDVDLGSGTRNIGIESETPNLDIIGKRIEKIKQEHETSWHYDQDHPYKTWAYHGSYETKQTGSASSMVNGVVRLLTKPWDVIPMVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKIGEFGRAKGSRAIWYMWLGARFLEFEALGFLNEDHWFSRENSLSGVEGEGLHKLGYILREVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMGAQLIRQMEGEGVFKSIQHLTTTEEVAVQDWLARVGRERLSRMAISGDDCVVKPLDDRFASALTALNDMGKVRKDIQQWEPSKGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHARHEWMTTEDMLTVWNRVWIQENPWMEDKTPVESWEEIPYLGKREDQWCGSLIGLTSRATWAKNIQTAINQVRSLIGSEEYTDYMPSMKRFRREEEEAGVLW

SEQ ID NO: 3788 - protein, 3291 aa, Artificial Sequence
  derived and/or modified protein sequence (wt) from DENV-2__KX380829__SS-prME
TAGVIIMLIPTAMAFHLTTRNGEPHMIVSRQEKGKSLLFKTEDGVNMCTLMAMDLGELCEDTITYNCPLLRQNEPEDIDCWCNSTSTWVTYGTCTATGEHRREKRSVALVPHVGMGLETRTETWMSSEGAWKHAQRIETWILRHPGFTIMAAILAYTIGTTYFQRVLIFILLTAVAPSMTMRCIGISNRDFVEGVSGGSWVDIVLEHGSCVTTMAKNKPTLDFELIKTEAKQPATLRKYCIEAKLTNTTTASRCPTQGEPSLNEEQDKRFVCKHSMVDRGWGNGCGLFGKGGIVTCAMFTCKKNMEGKIVQPENLEYTIVVTPHSGEENAVGNDTGKHGKEIKVTPQSSITEAELTGYGTVTMECSPRTGLDFNEMVLLQMENKAWLVHRQWFLDLPLPWLPGADTQGSNWIQKEMLVTFKNPHAKKQDVVVLGSQEGAMHTALTGATEIQMSSGNLLFTGHLKCRLRMDKLQLKGMSYSMCTGKFKVVKEIAETQHGTIVVRVQYEGDGSPCKIPFEIMDLEKRHVLGRLITVNPIVTEKDSPVNIEAEPPFGDSYIIIGVEPGQLKLSWFKKGSSIGQMFETTMRGAKRMAILGDTAWDFGSLGGVFTSIGKALHQVFGAIYGAAFSGVSWTMKILIGVVITWIGMNSRSTSLSVSLVLVGVVTLYLGVMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTEPHNQTFLIDGPETAECPNTNRAWNSLEVEDYGFGVFTTNIWLKLKERQDVFCDSKLMSAAIKDNRAVHADMGYWIESALNDTWKIEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYKGEDGCWYGMEIRPLKEKEENLVNSLVTAGHGQIDNFSLGVLGMALFLEEMLRTRVGTKHAVLLVAVSFMTLITGNMSFRDLGRVMVMVGAAMTDDIGMGVTYLALLAAFKVRPTFAAGLLLRKLTSKELMMTTIGIVLLSQSTIPETILELTDALALGMMILKIVRNMEKYQLAVTIMAILCAPNAVILQNAWKVSCTILAVVSVSPLLLTSSQQKADWIPLALTIKGLNPTAIFLTTLSRTNKKRSWPLNEAIMAVGMVSILASSLLKNDIPMTGPLVAGGLLTVCYVLTGRSADLELERAADVRWEDQAEISGSSPILSITISEDGSMSIKNEEEEQTLTILIRTGLLVISGLFPVSIPITAAAWYLWEVKKQRAGVLWDVPSPPPVGKAELEDGAYRIKQKGILGYSQIGAGVYKEGTFHTMWHVTRGAVLMHKGKRIEPSWADVRKDLISYGGGWKLEGEWKEGEEVQVLALEPGKNPRAVQTKPGLFKTNTGTIGAVSLDFSPGTSGSPIVDKKGKVVGLYGNGVVTRSGTYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYIKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVELMRRGDLPVWLAYRVAAEGINYADRRWCFDGIKNNQILEENVEVEIWTKEGEKKKLKPRWLDARIYSDPLALKEFKEFAAGRKSLTMNLITEMGRLPTFMTQKARNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDFGLGSIVAQQPESNILDIDLRPASAWTLYAVATTFITPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGMTVIDLDPIPYDPKFEKQLGQVMLLVLCVTQVLMMRTTWALCEALTLATGPISTLWEGNPGRFWNTTIAVSMANIFRGSYLAGAGLLFSIMKNTTNTRRGTGNTGETLGEKWKNRLNSLGKSEFQIYKRSGIQEVDRTLAKEGIKRGETDHHAVSRGSAKLRWFVERNLVTPEGKVMDLGCGRGGWSYYCGGLKNVREVKGLTKGGPGHEEPIPMSTYGWNLVRLQSGVDVFFTPPEKCDTLLCDIGESSPNPTVEAGRTLRVLNLVENWLNNNTQFCIKVLNPYMPSVIEKMETLQRKYGGALVRNPLSRNSTHEMYWVSNASGNIVSSVNMISRMLINRFTMRHKKATYEPDVDLGSGTRNIGIESETPNLDIIGKRIEKIKQEHETSWHYDQDHPYKTWAYHGSYETKQTGSASSMVNGVVRLLTKPWDVIPMVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKIGEFGRAKGSRAIWYMWLGARFLEFEALGFLNEDHWFSRENSLSGVEGEGLHKLGYILREVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMGAQLIRQMEGEGVFKSIQHLTTTEEVAVQDWLARVGRERLSRMAISGDDCVVKPLDDRFASALTALNDMGKVRKDIQQWEPSKGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHARHEWMTTEDMLTVWNRVWIQENPWMEDKTPVESWEEIPYLGKREDQWCGSLIGLTSRATWAKNIQTAINQVRSLIGSEEYTDYMPSMKRFRREEEEAGVLW

SEQ ID NO: 3789 - protein, 3291 aa, Artificial Sequence
  derived and/or modified protein sequence (wt) from DENV-2__KX380830__SS-prME
TAGIIIMMIPTVMAFHLTTRNGEPHMIVSRQEKGKSLLFKTENGVNMCTLMAMDLGELCEDTITYNCPLLRQNEPEDIDCWCNSTSTWVTYGTCTATGEHRREKRSVALVPHVGMGLETRTETWMSSEGAWKHAQRIETWVLRHPGFTVMAAILAYTIGTTYFQRVLIFILLTAVAPSMTMRCIGISNRDFVEGVSGGSWVDIVLEHGSCVTTMAKNKPTLDFELIKTEAKHPATLRKYCIEAKLTNTTTASRCPTQGEPSLNEEQDKRFVCKHSMVDRGWGNGCGLFGKGGIVTCAMFTCKKNMEGKIVQPENLEYTIVITPHSGEENAVGNDTGKHGKEIKVTPQSSITEAELTGYGTATMECSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRHVLGRLITVNPIVTEKDSPVNIEAEPPFGDSYIIIGVEPGQLKLSWFKKGSSIGQMFETTMRGAKRMAILGDTAWDFGSLGGVFTSIGKALHQVFGAIYGAAFSGVSWTMKILIGVVITWIGMNSRSTSLSVSLVLVGIVTLYLGVMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKAWGKAKMLSTELHNHTFLIDGPETAECPNTNRAWNSLEVEDYGFGVFTTNIWLKLKERQDVFCDSKLMSAAIKDNRAVHADMGYWIESALNDTWKIEKASFIEVKSCHWPKSHTLWSNGVLESEMIIPKNFAGPVSQHNYRPGYHTQTAGPWHLGRLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMTTIGIVLLSQSTIPETILELTDALALGMMVLKIVRNMEKYQLAVTIMAILCVPNAVILQNAWKVSCTILAVVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVRWEEQAEISGSSPILSITISEDGSMSIKNEEEEQTLTILIRTGLLVISGLFPVSIPITAAAWYLWEVKKQRAGVLWDVPSPPPVGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIVDKKGKVVGLYGNGVVTRSGTYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPIRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYIKTRTNDWDFVVTTDISEMGANFKAERVIDPRRCMKPVILTDGEERVILAGPMPVTHSSAAQRRGRVGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGVKNNQILEENVEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDFGLGSITTQQPDSNILDIDLRPASAWTLYAVATTFITPMLRHSIENSSVNVSLTAIANQATVLMGLGKGWPLSKMDIGVPLLAIGCYSQVNPITLTAALLLLVAHYAIIGPGLQAKATREAQKRAAAGIMKIPAADGMTVIDLDPIPYDPKFEKQLGQVMLLVLCVTQVLMMRTTWALCEALTLATGPISTLWEGNPGRFWNTTIAVSMANIFRGSYLAGAGLLFSIMKNTANTRRGTGNTGETLGEKWKNRLNALGKSEFQIYKKSGIQEVDRTLAKEGIKRGETDHHAVSRGSAKLRWFVERNLVTPEGKVVDLGCGRGGWSYYCGGLKNVKEVKGLTKGGPGHEEPIPMSTYGWNLVRLQSGVDVFFTPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMKHKKATYEPDVDLGSGTRNIGIESETPNLDIIGKRIEKIKQEHETSWHYDQDHPYKTWAYHGSYETKQTGSASSMVNGVVRLLTKPWDVIPMVTQMAMTDTTPFGQQRVFKEKVDTRTQEPKEGTKKLMKITAEWLWKELGKKKTPRMCTREEFTRKVRSNAALGAIFTDENKWKSAREAVEDSGFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHRKLAEAIFRLTYQNKVVRVQRPTPRGTVMDIISRRDQRGSGQVVTYGLNTFTNMEAQLIRQMEGEGVFKSIQHLTVTEEIAVKNWLERVGRERLSRMAISGDDCVVKPLDDRFASALTALNDMGKVRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWVPISRTTWSIHATHEWMTTEDMLTVWNRVWIQENPWMEDKTPVESWEEIPYLGKREDQWCGSLIGLTSRATWAKNIQTAINQVRSLIGNEEYTDYMPSMKRFRREEEEAGVLW

SEQ ID NO: 3790 - protein, 3291 aa, Artificial Sequence
  derived and/or modified protein sequence (wt) from DENV-2__KX380831__SS-prME
TAGIIIMMIPTVMAFHLTTRNGEPHMIVSRQEKGKSLLFKTENGVNMCTLMAMDLGELCEDTITYNCPLLRQNEPEDIDCWCNSTSTWVTYGTCTATGEHRREKRSVALVPHVGMGLETRTETWMSSEGAWKHAQRIETWILRHPGFTIMAAILAYTIGTTYFQRVLIFILLTAVTPSMAMRCIGISNRDFVEGVSGGSWVDIVLEHGSCVTTMAKNKPTLDFELIKTEAKHLATLRKYCVEAKLTNTTTASRCPTQGEPSLNEEQDKRFVCKHSMVDRGWGNGCGLFGKGGIVTCAMFTCKKNMEGKVVQPENLEYTIVITPHSGEENAVGNDTGKHGKEIKVTPQSSITEAELTGYGTVTMECSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRHVLGRLITVNPIVTEKDSPVNIEAEPPFGDSYIIIGVEPGQLKLSWFKKGSSIGQMFETTMRGAKRMAILGDTAWDFGSLGGVFTSIGKALHQVFGAIYGAAFSGVSWTMKILIGVVITWIGMNSRSTSLSVSLVLVGVVTLYLGVMVQADSGCVVSWKNKELKCGSGIFITDNVHTWTEQYKFQPESPSKLASAIQKAHEEGICGIRSVTRLENLMWKQITPELNHILTENEVKLTIMTGDIKGIMQAGKRSLRPQPTELKYSWKAWGKAKMLSTELHNHTFLIDGPETAECPNTNRAWNSLEVEDYGFGVFTTNIWLKLKERQDVFCDSNLMSAAIKDNRAVHADMGYWIESALNDTWKIEKASFIEVKSCHWPKSHTLWSNGVLESEMIIPKNFAGPVSQHNYRPGYHTQTAGPWHLGRLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMTTIGIVLLSQSTIPESILELTDALALGMMVLKIVRNMEKYQLAVTIMAILCVPNAVILQNAWKVSCTTLAVVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVRWEEQAEISGSSPILSITISEDGSMSIKNEEEEQTLTILIRTGLLVISGLFPVSIPITAAAWYLWEVKKQRAGVLWDVPSPPPVGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIVDKKGKVVGLYGNGVVTRSGTYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPIRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYIKTRTNDWDFVVTTDISEMGANFKAERVIDPRRCMKPVILTDGEERVILAGPMPVTHSSAAQRRGRVGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGVKNNQILEENVEVEIWTKEGERKKLKPRWLDARIYSDPLALKEFKEFAAGRKSLTLNLITEMGRLPTFMTQKAKNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDFGLGSITTQQPESNILDIDLRPASAWTLYAVATTFITPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGMTVIDLDPIPYDPKFEKQLGQVMLLVLCVTQVLMMRTTWALCEALTLATGPISTLWEGNPGRFWNTTIAVSMANIFRGSYLAGAGLLFSIMKNTANTRRGTGNTGETLGEKWKNRLNALGKSEFQIYKKSGIQEVDRTLAKEGIKRGETDHHAVSRGSAKLRWFVERNLVTPEGKVVDLGCGRGGWSYYCGGLKNVKEVKGLTKGGPGHEEPIPMSTYGWNLVRLQSGVDVFFTPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNTISRMLINRFTMRHKKATYEPDVDLGSGTRNIGIESETPNLDIIGKRIEKIKQEHETSWHYDQDHPYKTWAYHGSYETKQTGSASSMVNGVVRLLTKPWDVIPMVTQMAMTDTTPFGQQRVFKEKVDTRTQEPKEGTKKLMKITAEWLWKELGKKKTPRMCTREEFTRKVRSNAALGAIFTDENKWKSAREAVEDSGFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVVTYGLNTFTNMEAQLIRQMEGEGVFKSIQQLTVKEEIAVKNWLIRVGRERLSRMAISGDDCVVKPLDDRFASALTALNDMGKVRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWIPTSRTTWSIHATHEWMTTEDMLTVWNRVWIQENPWMEDKTPVESWEEIPYLGKREDQWCGSLIGLTSRATWAKNIQTAINQVRSLIGNEEYTDYMPSMKRFRREEEEAGVLW

SEQ ID NO: 3791 - protein, 3291 aa, Artificial Sequence
  derived and/or modified protein sequence (wt) from DENV-2__KX380808__SS-prME
TAGIIIMMIPTVMAFHLTTRNGEPHMIVSRQEKGKSLLFKTENGVNMCTLMAMDLGELCEDTITYNCPLLKQNEPEDIDCWCNSTSTWVTYGTCTATGEHRREKRSVALVPHVGMGLETRTETWMSSEGAWKHAQRIETWVLRHPGFTIMAAILAYTIGTTYFQRVLIFILLTAIAPSMTMRCIGISNRDFVEGVSGGSWVDIVLEHGSCVTTMAKNKPTLDFELIKTEAKHPATLRKYCIEAKLTNTTTASRCPTQGEPSLNEEQDKRFVCKHSMVDRGWGNGCGLFGKGGIVTCAMFTCKKNMEGKIVQPENLEYTIVITPHSGEENAVGNDTGKHGKEIKVTPQSSITEAELTGYGTVTMECSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRHVLGRLITVNPIVTEKDSPVNIEAEPPFGDSYIIIGVEPGQLKLSWFKKGSSIGQMFETTMRGAKRMAILGDTAWDFGSLGGVFTSIGKALHQVFGAIYGAAFSGVSWTMKILIGVVITWIGMNSRSTSLSVSLVLVGVVTLYLGVMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKAWGKAKMLSTELHNHTFLIDGPETAECPNTNRAWNSLEVEDYGFGVFTTNIWLKLKERQDVFCDSKLMSAAIKDNRAVHADMGYWIESALNDTWKIEKASFIEIKSCHWPKSHTLWSNGVLESEMIIPKNFAGPVSQHNYRPGYHTQTAGPWHLGRLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMTTIGIVLLSQSTIPETILELTDALALGMMVLKIVRNMEKYQLAVTIMAILCVPNAVILQNAWKVSCTTLAVVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVRWEEQAEISGSSPILSITISEDGSMSIKNEEEEQTLTILIRTGLLVISGLFPVSIPITAAAWYLWEVKKQRAGVLWDVPSPPPVGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIVDKKGKVVGLYGNGVVTRSGTYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPIRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDTEYIKTRTNDWDFVVTTDISEMGANFKAERVIDPRRCMKPVILTDGEERVILAGPMPVTHSSAAQRRGRVGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGVKNNQILEENVEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDFGLGSITTQQPESNILDIDLRPASAWTLYAVATTFITPMLRHSIENSSVNVSLTAIANQATVLMGLGKGWPLSKMDIGVPLLAIGCYSQVNPITLTAALLLLVTHYAIIGPGLQAKATREAQKRAAAGIMKIPTVDGITVIDLDPIPYDPKFEKQLGQVMLLVLCVTQVLMMRTTWALCEALTLATGPISTLWEGNPGRFWNTTIAVSMANIFRGSYLAGAGLLFSIMKNTANTRRGTGNTGETLGEKWKNRLNALGKSEFQIYKKSGIQEVDRTLAKEGIKRGETDHHAVSRGSAKLRWFVERNLVTPEGKVVDLGCGRGGWSYYCGGLKNVKEVKGLTKGGPGHEEPIPMSTYGWNLVRLQSGVDVFFTPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESETPNLDIIGKRIEKIKQEHETSWHYDQDHPYKTWAYHGSYETKQTGSASSMVNGVVRLLTKPWDVIPMVTQMAMTDTTPFGQQRVFKEKVDTRTQEPKEGTKKLMKITAEWLWKELGKKKTPRMCTREEFTRKVRSNAALGAIFTDENKWKSAREAVEDSGFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFRLTYQNKVVRVQRPTPRGTVMDIISRRDQRGSGQVVTYGLNTFTNMEAQLIRQMEGEGLFKSIQHLTVTEEIAVKNWLVRVGRERLSRMAISGDDCVVKPLDDRFASALTALNDMGKVRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHATHEWMTTEDMLTVWNRVWIQENPWMEDKTPVESWEEIPYLGKREDQWCGSLIGLTSRATWAKNIQTAINQVRSLIGNEEYTDYMPSMKRFRREEEEAGVLW

SEQ ID NO: 3792 - protein, 3291 aa, Artificial Sequence
  derived and/or modified protein sequence (wt) from DENV-2__KX380832__SS-prME
TAGIIIMMIPTVMAFHLTTRNGEPHMIVSRQEKGKSLLFKTENGVNMCTLMAMDLGELCEDTITYNCPLLRQNEPEDIDCWCNSTSTWVTYGTCTATGEHRREKRSVALVPHVGMGLETRTETWMSSEGAWKHAQRIETWVLRHPGFTVMAAILAYTIGTTYFQRVLIFILLTAVAPSMTMRCIGISNRDFVEGVSGGSWVDIVLEHGSCVTTMAKNKPTLDFELIKTEAKHPATLRKYCIEAKLTNTTTASRCPTQGEPSLNEEQDKRFVCKHSMVDRGWGNGCGLFGKGGIVTCAMFTCKKNMEGKIVQPENLEYTIVITPHSGEENAVGNDTGKHGKEIKVTPQSSITEAELTGYGTATMECSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRHVLGRLITVNPIVTEKDSPVNIEAEPPFGDSYIIIGVEPGQLKLSWFKKGSSIGQMFETTMRGAKRMAILGDTAWDFGSLGGVFTSIGKALHQVFGAIYGAAFSGVSWTMKILIGVVITWIGMNSRSTSLSVSLVLVGIVTLYLGVMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKAWGKAKMLSTELHNHTFLIDGPETAECPNTNRAWNSLEVEDYGFGVFTTNIWLKLKERQDVFCDSKLMSAAIKDNRAVHADMGYWIESALNDTWKIEKASFIEVKSCHWPKSHTLWSNGVLESEMIIPKNFAGPVSQHNYRPGYHTQTAGPWHLGRLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMTTIGIVLLSQSTIPETILELTDALALGMMVLKIVRNMEKYQLAVTIMTILCVPNAVILQNAWKVSCTILAVVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVRWEEQAEISGSSPILSITISEDGSMSIKNEEEEQTLTILIRTGLLVISGLFPVSIPITAAAWYLWEVKKQRAGVLWDVPSPPPVGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIVDKKGKVVGLYGNGVVTRSGTYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPIRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDITACLRKNGKKVIQLSRKTFDSEYIKTRTNDWDFVVTTDISEMGANFKAERVIDPRRCMKPVILTDGEERVILAGPMPVTHSSAAQRRGRVGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGVKNNQILEENVEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDFGLGSITTQQPDSNILDIDLRPASAWTLYAVATTFITPMLRHSIENSSVNVSLTAIANQATVLMGLGKGWPLSKMDIGVPLLAIGCYSQVNPITLTAALLLLVAHYAIIGPGLQAKATREAQKRAAAGIMKIPAADGITVIDLDPIPYDPKFEKQLGQVMLLVLCVTQVLMMRTTWALCEALTLATGPISTLWEGNPGRFWNTTIAVSMANIFRGSYLAGAGLLFSIMKNTANTRRGTGNTGETLGEKWKNRLNALGKSEFQIYKKSGIQEVDRTLAKEGIKRGETDHHAVSRGSAKLRWFVERNLVTPEGKVVDLGCGRGGWSYYCGGLKNVKEVKGLTKGGPGHEEPIPMSTYGWNLVRLQSGVDVFFTPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMKHKKATYEPDVDLGSGTRNIGIESETPNLDIIGKRIEKIKQEHETSWHYDQDHPYKTWAYHGSYETKQTGSASSMVNGVVRLLTKPWDVIPMVTQMAMTDTTPFGQQRVFKEKVDTRTQEPKEGTKKLMKITAEWLWKELGKKKTPRMCTREEFTRKVRSNAALGAIFTDENKWKSAREAVEDSGFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHRKLAEAIFRLTYQNKVVRVQRPTPRGTVMDIISRRDQRGSGQVVTYGLNTFTNMEAQLIRQMEGEGVFKSIQHLTVTEEIAVKNWLERVGRERLSRMAISGDDCVVKPLDDRFASALTALNDMGKVRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHATHEWMTTEDMLTVWNRVWIQENPWMEDKTPVESWEEIPYLGKREDQWCGSLIGLTSRATWAKNIQTAINQVRSLIGNEEYTDYMPSMKRFRREEEEAGVLW

SEQ ID NO: 3793 - protein, 3291 aa, Artificial Sequence
  derived and/or modified protein sequence (wt) from DENV-2__KX380833__SS-prME
TAGIIIMMIPTVMAFHLTTRNGEPHMIVSRQEKGKSLLFKTENGVNMCTLMAMDLGELCEDTITYNCPLLRQNEPEDIDCWCNSTSTWVTYGTCTATGEHRREKRSVALVPHVGMGLETRTETWMSSEGAWKHAQRIETWVLRHPGFTVMAAILAYTIGTTYFQRVLIFILLTAVAPSMTMRCIGISNRDFVEGVSGGSWVDIVLEHGSCVTTMAKNKPTLDFELIKTEAKHPATLRKYCIEAKLTNTTTASRCPTQGEPSLNEEQDKRFVCKHSMVDRGWGNGCGLFGKGGIVTCAMFTCKKNMEGKIVQPENLEYTIVITPHSGEENAVGNDTGKHGKEIKVTPQSSITEAELTGYGTATMECSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRHVLGRLITVNPIVTEKDSPVNIEAEPPFGDSYIIIGVEPGQLKLSWFKKGSSIGQMFETTMRGAKRMAILGDTAWDFGSLGGVFTSIGKALHQVFGAIYGAAFSGVSWTMKILIGVVITWIGMNSRSTSLSVSLVLVGIVTLYLGVMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKAWGKAKMLSTELHNHTFLIDGPETAECPNTNRAWNSLEVEDYGFGVFTTNIWLKLKERQDVFCDSKLMSAAIKDNRAVHADMGYWIESALNDTWKIEKASFIEVKSCHWPKSHTLWSNGVLESEMIIPKNFAGPVSQHNYRPGYHTQTAGPWHLGRLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMTTIGIVLLSQSTIPETILELTDALALGMMVLKIVRNMEKYQLAVTIMAILCVPNAVILQNAWKVSCTILAVVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVRWEEQAEISGSSPILSITISEDGSMSIKNEEEEQTLTILIRTGLLVISGLFPVSIPITAAAWYLWEVKKQRAGVLWDVPSPPPVGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIVDKKGKVVGLYGNGVVTRSGTYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPIRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYIKTRTNDWDFVVTTDISEMGANFKAERVIDPRRCMKPVILTDGEERVILAGPMPVTHSSAAQRRGRVGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGVKNNQILEENVEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDFGLGSITTQQPDSNILDIDLRPASAWTLYAVATTFITPMLRHSIENSSVNVSLTAIANQATVLMGLGKGWPLSKMDIGVPLLAIGCYSQVNPITLTAALLLLVAHYAIIGPGLQAKATREAQKRAAAGIMKIPAADGITVIDLDPIPYDPKFEKQLGQVMLLVLCVTQVLMMRTTWALCEALTLATGPISTLWEGNPGRFWNTTIAVSMANIFRGSYLAGAGLLFSIMKNTANTRRGTGNTGETLGEKWKNRLNALGKSEFQIYKKSGIQEVDRTLAKEGIKRGETDHHAVSRGSAKLRWFVERNLVTPEGKVVDLGCGRGGWSYYCGGLKNVKEVKGLTKGGPGHEEPIPMSTYGWNLVRLQSGVDVFFTPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMKHKKATYEPDVDLGSGTRNIGIESETPNLDIIGKRIEKIKQEHETSWHYDQDHPYKTWAYHGSYETKQTGSASSMVNGVVRLLTKPWDVIPMVTQMAMTDTTPFGQQRVFKEKVDTRTQEPKEGTKKLMKITAEWLWKELGKKKTPRMCTREEFTRKVRSNAALGAIFTDENKWKSAREAVEDSGFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHRKLAEAIFRLTYQNKVVRVQRPTPRGTVMDIISRRDQRGSGQVVTYGLNTFTNMEAQLIRQMEGEGVFKSIQHLTVTEEIAVKNWLERVGRERLSRMAISGDDCVVKPLDDRFASALTALNDMGKVRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWVPISRTTWSIHATHEWMTTEDMLTVWNRVWIQENPWMEDKTPVESWEEIPYLGKREDQWCGSLIGLTSRATWAKNIQTAINQVRSLIGNEEYTDYMPSMKRFRREEEEAGVLW

SEQ ID NO: 3794 - protein, 3291 aa, Artificial Sequence
  derived and/or modified protein sequence (wt) from DENV-2__KX380834__SS-prME
TAGIIIMMIPTVMAFHLTTRNGEPHMIVSRQEKGKSLLFKTENGVNMCTLMAMDLGELCEDTITYNCPLLRQNEPEDIDCWCNSTSTWVTYGTCTATGEHRREKRSVALVPHVGMGLETRTETWMSSEGAWKHAQRIETWILRHPGFTIMAAILAYTIGTTYFQRVLIFILLTAVTPSMAMRCIGISNRDFVEGVSGGSWVDIVLEHGSCVTTMAKNKPTLDFELIKTEAKHLATLRKYCVEAKLTNTTTASRCPTQGEPSLNEEQDKRFVCKHSMVDRGWGNGCGLFGKGGIVTCAMFTCKKNMEGKVVQPENLEYTIVITPHSGEENAVGNDTGKHGKEIKVTPQSSITEAELTGYGTVTMECSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRHVLGRLITVNPIVTEKDSPVNIEAEPPFGDSYIIIGVEPGQLKLSWFKKGSSIGQMFETTMRGAKRMAILGDTAWDFGSLGGVFTSIGKALHQVFGAIYGAAFSGVSWTMKILIGVVITWIGMNSRSTSLSVSLVLVGVVTLYLGVMVQADSGCVVSWKNKELKCGSGIFITDNVHTWTEQYKFQPESPSKLASAIQKAHEEGICGIRSVTRLENLMWKQITPELNHILTENEVKLTIMTGDIKGIMQAGKRSLRPQPTELKYSWKAWGKAKMLSTELHNHTFLIDGPETAECPNTNRAWNSLEVEDYGFGVFTTNIWLKLKERQDVFCDSNLMSAAIKDNRAVHADMGYWIESALNDTWKIEKASFIEVKSCHWPKSHTLWSNGVLESEMIIPKNFAGPVSQHNYRPGYHTQTAGPWHLGRLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMTTIGIVLLSQSTIPESILELTDALALGMMVLKIVRNMEKYQLAVTIMAILCVPNAVILQNAWKVSCTTLAVVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVRWEEQAEISGSSPILSITISEDGSMSIKNEEEEQTLTILIRTGLLVISGLFPVSIPITAAAWYLWEVKKQRAGVLWDVPSPPPVGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIVDKKGKVVGLYGNGVVTRSGTYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPIRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYIKTRTNDWDFVVTTDISEMGANFKAERVIDPRRCMKPVILTDGEERVILAGPMPVTHSSAAQRRGRVGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGVKNNQILEENVEVEIWTKEGERKKLKPRWLDARIYSDPLALKEFKEFAAGRKSLTLNLITEMGRLPTFMTQKAKNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDFGLGSITTQQPESNILDIDLRPASAWTLYAVATTFITPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGMTVIDLDPIPYDPKFEKQLGQVMLLVLCVTQVLMMRTTWALCEALTLATGPISTLWEGNPGRFWNTTIAVSMANIFRGSYLAGAGLLFSIMKNTANTRRGTGNTGETLGEKWKNRLNALGKSEFQIYKKSGIQEVDRTLAKEGIKRGETDHHAVSRGSAKLRWFVERNLVTPEGKVVDLGCGRGGWSYYCGGLKNVKEVKGLTKGGPGHEEPIPMSTYGWNLVRLQSGVDVFFTPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESETPNLDIIGKRIEKIKQEHETSWHYDQDHPYKTWAYHGSYETKQTGSASSMVNGVVRLLTKPWDVIPMVTQMAMTDTTPFGQQRVFKEKVDTRTQEPKEGTKKLMKITAEWLWKELGKKKTPRMCTREEFTRKVRSNAALGAIFTDENKWKSAREAVEDSGFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVVTYGLNTFTNMEAQLIRQMEGEGVFKSIQQLTVKEEIAVKNWLIRVGRERLSRMAISGDDCVVKPLDDRFASALTALNDMGKVRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWIPTSRTTWSIHATHEWMTTEDMLTVWNRVWIQENPWMEDKTPVESWEEIPYLGKREDQWCGSLIGLTSRATWAKNIQTAINQVRSLIGNEEYTDYMPSMKRFRREEEEAGVLW

SEQ ID NO: 3795 - protein, 3291 aa, Artificial Sequence
  derived and/or modified protein sequence (wt) from DENV-2__KX380835__SS-prME
TAGIIIMMIPTVMAFHLTTRNGEPHMIVSRQEKGKSLLFKTENGVNMCTLMAMDLGELCEDTITYNCPLLRQNEPEDIDCWCNSTSTWVTYGTCTATGEHRREKRSVALVPHVGMGLETRTETWMSSEGAWKHAQRIETWVLRHPGFTVMAAILAYTIGTTYFQRVLIFILLTAVAPSMTMRCIGISNRDFVEGVSGGSWVDIVLEHGSCVTTMAKNKPTLDFELIKTEAKHPATLRKYCIEAKLTNTTTASRCPTQGEPSLNEEQDKRFVCKHSMVDRGWGNGCGLFGKGGIVTCAMFTCKKNMEGKIVQPENLEYTIVITPHSGEENAVGNDTGKHGKEIKVTPQSSITEAELTGYGTATMECSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRHVLGRLITVNPIVTEKDSPVNIEAEPPFGDSYIIIGVEPGQLKLSWFKKGSSIGQMFETTMRGAKRMAILGDTAWDFGSLGGVFTSIGKALHQVFGAIYGAAFSGVSWTMKILIGVVITWIGMNSRSTSLSVSLVLVGIVTLYLGVMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKAWGKAKMLSTELHNHTFLIDGPETAECPNTNRAWNSLEVEDYGFGVFTTNIWLKLKERQDVFCDSKLMSAAIKDNRAVHADMGYWIESALNDTWKIEKASFIEVKSCHWPKSHTLWSNGVLESEMIIPKNFAGPVSQHNYRPGYHTQTAGPWHLGRLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMTTIGIVLLSQSTIPETILELTDALALGMMVLKIVRNMEKYQLAVTIMAILCVPNAVILQNAWKVSCTILAVVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVRWEEQAEISGSSPILSITISEDGSMSIKNEEEEQTLTILIRTGLLVISGLFPVSIPITAAAWYLWEVKKQRAGVLWDVPSPPPVGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIVDKKGKVVGLYGNGVVTRSGTYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPIRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYIKTRTNDWDFVVTTDISEMGANFKAERVIDPRRCMKPVILTDGEERVILAGPMPVTHSSAAQRRGRVGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGVKNNQILEENVEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDFGLGSITTQQPDSNILDIDLRPASAWTLYAVATTFITPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGMTVIDLDPIPYDPKFEKQLGQVMLLVLCVTQVLMMRTTWALCEALTLATGPISTLWEGNPGRFWNTTIAVSMANIFRGSYLAGAGLLFSIMKNTANTRRGTGNTGETLGEKWKNRLNALGKSEFQIYKKSGIQEVDRTLAKEGIKRGETDHHAVSRGSAKLRWFVERNLVTPEGKVVDLGCGRGGWSYYCGGLKNVKEVKGLTKGGPGHEEPIPMSTYGWNLVRLQSGVDVFFTPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMKHKKATYEPDVDLGSGTRNIGIESETPNLDIIGKRIEKIKQEHETSWHYDQDHPYKTWAYHGSYETKQTGSASSMVNGVVRLLTKPWDVIPMVTQMAMTDTTPFGQQRVFKEKVDTRTQEPKEGTKKLMKITAEWLWKELGKKKTPRMCTREEFTRKVRSNAALGAIFTDENKWKSAREAVEDSGFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHRKLAEAIFRLTYQNKVVRVQRPTPRGTVMDIISRRDQRGSGQVVTYGLNTFTNMEAQLIRQMEGEGVFKSIQHLTVTEEIAVKNWLERVGRERLSRMAISGDDCVVKPLDDRFASALTALNDMGKVRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWVPISRTTWSIHATHEWMTTEDMLTVWNRVWIQENPWMEDKTPVESWEEIPYLGKREDQWCGSLIGLTSRATWAKNIQTAINQVRSLIGNEEYTDYMPSMKRFRREEEEAGVLW

SEQ ID NO: 3796 - protein, 3291 aa, Artificial Sequence
  derived and/or modified protein sequence (wt) from DENV-2__KX380836__SS-prME
TAGIIIMMIPTVMAFHLTTRNGEPHMIVSRQEKGKSLLFKTENGVNMCTLMAMDLGELCEDTITYNCPLLRQNEPEDIDCWCNSTSTWVTYGTCTATGEHRREKRSVALVPHVGMGLETRTETWMSSEGAWKHAQRIETWVLRHPGFTVMAAILAYTIGTTYFQRVLIFILLTAVAPSMTMRCIGISNRDFVEGVSGGSWVDIVLEHGSCVTTMAKNKPTLDFELIKTEAKHPATLRKYCIEAKLTNTTTASRCPTQGEPSLNEEQDKRFVCKHSMVDRGWGNGCGLFGKGGIVTCAMFTCKKNMEGKIVQPENLEYTIVITPHSGEENAVGNDTGKHGKEIKVTPQSSITEAELTGYGTATMECSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRHVLGRLITVNPIVTEKDSPVNIEAEPPFGDSYIIIGVEPGQLKLSWFKKGSSIGQMFETTMRGAKRMAILGDTAWDFGSLGGVFTSIGKALHQVFGAIYGAAFSGVSWTMKILIGVVITWIGMNSRSTSLSVSLVLVGIVTLYLGVMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKAWGKAKMLSTELHNHTFLIDGPETAECPNTNRAWNSLEVEDYGFGVFTTNIWLKLKERQDVFCDSKLMSAAIKDNRAVHADMGYWIESALNDTWKIEKASFIEVKSCHWPKSHTLWSNGVLESEMIIPKNFAGPVSQHNYRPGYHTQTAGPWHLGRLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMTTIGIVLLSQSTIPETILELTDALALGMMVLKIVRNMEKYQLAVTIMAILCVPNAVILQNAWKVSCTILAVVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVRWEEQAEISGSSPILSITISEDGSMSIKNEEEEQTLTILIRTGLLVISGLFPVSIPITAAAWYLWEVKKQRAGVLWDVPSPPPVGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIVDKKGKVVGLYGNGVVTRSGTYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPIRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYIKTRTNDWDFVVTTDISEMGANFKAERVIDPRRCMKPVILTDGEERVILAGPMPVTHSSAAQRRGRVGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGVKNNQILEENVEVEIWTKEGERKKLKPRWLDARIYSDPLALKEFKEFAAGRKSLTLNLITEMGRLPTFMTQKAKNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDFGLGSITTQQPESNILDIDLRPASAWTLYAVATTFITPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGMTVIDLDPIPYDPKFEKQLGQVMLLVLCVTQVLMMRTTWALCEALTLATGPISTLWEGNPGRFWNTTIAVSMANIFRGSYLAGAGLLFSIMKNTANTRRGTGNTGETLGEKWKNRLNALGKSEFQIYKKSGIQEVDRTLAKEGIKRGETDHHAVSRGSAKLRWFVERNLVTPEGKVVDLGCGRGGWSYYCGGLKNVKEVKGLTKGGPGHEEPIPMSTYGWNLVRLQSGVDVFFTPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMKHKKATYEPDVDLGSGTRNIGIESETPNLDIIGKRIEKIKQEHETSWHYDQDHPYKTWAYHGSYETKQTGSASSMVNGVVRLLTKPWDVIPMVTQMAMTDTTPFGQQRVFKEKVDTRTQEPKEGTKKLMKITAEWLWKELGKKKTPRMCTREEFTRKVRSNAALGAIFTDENKWKSAREAVEDSGFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHRKLAEAIFRLTYQNKVVRVQRPTPRGTVMDIISRRDQRGSGQVVTYGLNTFTNMEAQLIRQMEGEGVFKSIQHLTVTEEIAVKNWLERVGRERLSRMAISGDDCVVKPLDDRFASALTALNDMGKVRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWVPISRTTWSIHATHEWMTTEDMLTVWNRVWIQENPWMEDKTPVESWEEIPYLGKREDQWCGSLIGLTSRATWAKNIQTAINQVRSLIGNEEYTDYMPSMKRFRREEEEAGVLW

SEQ ID NO: 3797 - protein, 3291 aa, Artificial Sequence
  derived and/or modified protein sequence (wt) from DENV-2__KX380838__SS-prME
TAGIIIMMIPTVMAFHLTTRNGEPHMIVSRQEKGKSLLFKTENGVNMCTLMAMDLGELCEDTITYNCPLLRQNEPEDIDCWCNSTSTWVTYGTCTATGEHRREKRSVALVPHVGMGLETRTETWMSSEGAWKHAQRIETWVLRHPGFTVMAAILAYTIGTTYFQRVLIFILLTAVAPSMTMRCIGISNRDFVEGVSGGSWVDIVLEHGSCVTTMAKNKPTLDFELIKTEAKHPATLRKYCIEAKLTNTTTASRCPTQGEPSLNEEQDKRFVCKHSMVDRGWGNGCGLFGKGGIVTCAMFTCKKNMEGKIVQPENLEYTIVITPHSGEENAVGNDTGKHGKEIKVTPQSSITEAELTGYGTATMECSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRHVLGRLITVNPIVTEKDSPVNIEAEPPFGDSYIIIGVEPGQLKLSWFKKGSSIGQMFETTMRGAKRMAILGDTAWDFGSLGGVFTSIGKALHQVFGAIYGAAFSGVSWTMKILIGVVITWIGMNSRSTSLSVSLVLVGIVTLYLGVMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKAWGKAKMLSTELHNHTFLIDGPETAECPNTNRAWNSLEVEDYGFGVFTTNIWLKLKERQDVFCDSKLMSAAIKDNRAVHADMGYWIESALNDTWKIEKASFIEVKSCHWPKSHTLWSNGVLESEMIIPKNFAGPVSQHNYRPGYHTQTAGPWHLGRLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMTTIGIVLLSQSTIPETILELTDALALGMMVLKIVRNMEKYQLAVTIMATLCVPNAVILQNAWKVSCTILAVVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVRWEEQAEISGSSPILSITISEDGSMSIKNEEEEQTLTILIRTGLLVISGLFPVSIPITAAAWYLWEVKKQRAGVLWDVPSPPPVGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIVDKKGKVVGLYGNGVVTRSGTYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPIRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYIKTRTNDWDFVVTTDISEMGANFKAERVIDPRRCMKPVILTDGEERVILAGPMPVTHSSAAQRRGRVGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGVKNNQILEENVEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDFGLGSITTQQPDSNILDIDLRPASAWTLYAVATTFITPMLRHSIENSSVNVSLTAIANQATVLMGLGKGWPLSKMDIGVPLLAIGCYSQVNPITLTAALLLLVAHYAIIGPGLQAKATREAQKRAAAGIMKIPAADGITVIDLDPIPYDPKFEKQLGQVMLLVLCVTQVLMMRTTWALCEALTLATGPISTLWEGNPGRFWNTTIAVSMANIFRGSYLAGAGLLFSIMKNTANTRRGTGNTGETLGEKWKNRLNALGKSEFQIYKKSGIQEVDRTLAKEGIKRGETDHHAVSRGSAKLRWFVERNLVTPEGKVVDLGCGRGGWSYYCGGLKNVKEVKGLTKGGPGHEEPIPMSTYGWNLVRLQSGVDVFFTPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMKHKKATYEPDVDLGSGTRNIGIESETPNLDIIGKRIEKIKQEHETSWHYDQDHPYKTWAYHGSYETKQTGSASSMVNGVVRLLTKPWDVIPMVTQMAMTDTTPFGQQRVFKEKVDTRTQEPKEGTKKLMKITAEWLWKELGKKKTPRMCTREEFTRKVRSNAALGAIFTDENKWKSAREAVEDSGFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHRKLAEAIFRLTYQNKVVRVQRPTPRGTVMDIISRRDQRGSGQVVTYGLNTFTNMEAQLIRQMEGEGVFKSIQHLTVTEEIAVKNWLERVGRERLSRMAISGDDCVVKPLDDRFASALTALNDMGKVRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWVPISRTTWSIHATHEWMTTEDMLTVWNRVWIQENPWMEDKTPVESWEEIPYLGKREDQWCGSLIGLTSRATWAKNIQTAINQVRSLIGNEEYTDYMPSMKRFRREEEEAGVLW

SEQ ID NO: 3798 - protein, 3291 aa, Artificial Sequence
  derived and/or modified protein sequence (wt) from DENV-2__KM279515__SS-prME
TAGIIIMMIPTVMAFHLTTRNGEPHMIVSRQEKGKSLLFKTENGVNMCTLMAMDLGELCEDTITYNCPLLRQNEPEDIDCWCNSTSTWVTYGTCTATGEHRREKRSVALVPHVGMGLETRTETWMSSEGAWKHAQRIETWILRHPGFTIMAAILAYTIGTTYFQRVLIFILLTAVTPSMAMRCIGISNRDFVEGVSGGSWVDIVLEHGSCVTTMAKNKPTLDFELIKTEAKHLATLRKYCVEAKLTNTTTASRCPTQGEPSLNEEQDKRFVCKHSMVDRGWGNGCGLFGKGGIVTCAMFTCKKNMEGKVVQPENLEYTIVITPHSGEENAVGNDTGKHGKEIKVTPQSSITEAELTGYGTVTMECSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRHALGRLITVNPIVTEKDSPVNIEAEPPFGDSYIIIGVEPGQLKLSWFKKGSSIGQMFETTMRGAKRMAILGDTAWDFGSLGGVFTSIGKALHQVFGAIYGAAFSGVSWTMKILIGVVITWIGMNSRSTSLSVSLVLVGVVTLYLGVMVQADSGCVVSWKNKELKCGSGIFITDNVHTWTEQYKFQPESPSKLASAIQKAHEEGICGIRSVTRLENLMWKQITPELNHILTENEVKLTIMTGDIKGIMQAGKRSLRPQPTELKYSWKAWGKAKMLSTELHNHTFLIDGPETAECPNTNRAWNSLEVEDYGFGVFTTNIWLKLKERQDVFCDSKLMSAAIKDNRAVHADMGYWIESALNDTWKIEKASFIEVKSCHWPKSHTLWSNGVLESEMIIPKNFAGPVSQHNYRPGYHTQTAGPWHLGRLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMTTIGIVLLSQSTIPESILELTDALALGMMVLKIVRNMEKYQLAVTIMAILCVPNAVILQNAWKVSCTTLAVVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVRWEEQAEISGSSPILSITISEDGSMSIKNEEEEQTLTILIRTGLLVISGLFPVSIPITAAAWYLWEVKKQRAGVLWDVPSPPPVGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIVDKKGKVVGLYGNGVVTRSGTYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPIRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYIKTRTNDWDFVVTTDISEMGANFKAERVIDPRRCMKPVILTDGEERVILAGPMPVTHSSAAQRRGRVGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGVKNNQILEENVEVEIWTKEGERKKLKPRWLDARIYSDPLALKEFKEFAAGRKSLTLNLITEMGRLPTFMTQKAKNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDFGLGSITTQQPESNILDIDLRPASAWTLYAVATTFITPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGMTVIDLDPIPYDPKFEKQLGQVMLLVLCVTQVLMMRTTWALCEALTLATGPISTLWEGNPGRFWNTTIAVSMANIFRGSYLAGAGLLFSIMKNTANTRRGTGNTGETLGEKWKNRLNALGKSEFQIYKKSGIQEVDRTLAKEGIKRGETDHHAVSRGSAKLRWFVERNLVTPEGKVVDLGCGRGGWSYYCGGLKNVKEVKGLTKGGPGHEEPIPMSTYGWNLVRLQSGVDVFFTPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESETPNLDIIGKRIEKIKQEHETSWHYDQDHPYKTWAYHGSYETKQTGSASSMVNGVVRLLTKPWDVIPMVTQMAMTDTTPFGQQRVFKEKVDTRTQEPKEGTKKLMKITAEWLWKELGKKKTPRMCTREEFTRKVRSNAALGAIFTDENKWKSAREAVEDSGFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVVTYGLNTFTNMEAQLIRQMEGEGVFKSIQQLTVKEEIAVKNWLIRVGRERLSRMAISGDDCVVKPLDDRFASALTALNDMGKVRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWIPTSRTTWSIHATHEWMTTEDMLTVWNRVWIQENPWMEDKTPVETWEEIPYLGKREDQWCGSLIGLTSRATWAKNIQTAINQVRSLIGNEEYTDYMPSMKRFRREEEEAGVLW

SEQ ID NO: 3799 - protein, 3291 aa, Artificial Sequence
  derived and/or modified protein sequence (wt) from DENV-2__KM279516__SS-prME
TAGIIIMMIPTVMAFHLTTRNGEPHMIVSRQEKGKSLLFKTENGVNMCTLMAMDLGELCEDTITYNCPLLRQNEPEDIDCWCNSTSTWVTYGTCTATGEHRREKRSVALVPHVGMGLETRTETWMSSEGAWKHAQRIETWILRHPGFTIMAAILAYTIGTTYFQRVLIFILLTAVTPSMAMRCIGISNRDFVEGVSGGSWVDIVLEHGSCVTTMAKNKPTLDFELIKTEAKHLATLRKYCVEAKLTNTTTASRCPTQGEPSLNEEQDKRFVCKHSMVDRGWGNGCGLFGKGGIVTCAMFTCKKNMEGKVVQPENLEYTIVITPHSGEENAVGNDTGKHGKEIKVTPQSSITEAELTGYGTVTMECSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRHVLGRLITVNPIVTEKDSPVNIEAEPPFGDSYIIIGVEPGQLKLSWFKKGSSIGQMFETTMRGAKRMAILGDTAWDFGSLGGVFTSIGKALHQVFGAIYGAAFSGVSWTMKILIGVVITWIGMNSRSTSLSVSLVLVGVVTLYLGVMVQADSGCVVSWKNKELKCGSGIFITDNVHTWTEQYKFQPESPSKLASAIQKAHEEGICGIRSVTRLENLMWKQITPELNHILTENEVKLTIMTGDIKGIMQAGKRSLRPQPTELKYSWKAWGKAKMLSTELHNHTFLIDGPETAECPNTNRAWNSLEVEDYGFGVFTTNIWLKLKERQDVFCDSKLMSAAIKDNRAVHADMGYWIESALNDTWKIEKASFIEVKSCHWPKSHTLWSNGVLESEMIIPKNFAGPVSQHNYRPGYHTQTAGPWHLGRLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMTTIGIVLLSQSTIPENILELTDALALGMMVLKIVRNMEKYQLAVTIMAILCVPNAVILQNAWKVSCTTLAVVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVRWEEQAEISGSSPILSITISEDGSMSIKNEEEEQTLTILIRTGLLVISGLFPVSIPITAAAWYLWEVKKQRAGVLWDVPSPPPVGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIVDKKGKVVGLYGNGVVTRSGTYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPIRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYIKTRTNDWDFVVTTDISEMGANFKAERVIDPRRCMKPVILTDGEERVILAGPMPVTHSSAAQRRGRVGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGVKNNQILEENVEVEIWTKEGERKKLKPRWLDARIYSDPLALKEFKEFAAGRKSLTLNLITEMGRLPTFMTQKAKNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDFGLGSITTQQPESNILDIDLRPASAWTLYAVATTFITPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGMTVIDLDPIPYDPKFEKQLGQVMLLVLCVTQVLMMRTTWALCEALTLATGPISTLWEGNPGRFWNTTIAVSMANIFRGSYLAGAGLLFSIMKNTANTRRGTGNTGETLGEKWKNRLNALGKSEFQIYKKSGIQEVDRTLAKEGIKRGETDHHAVSRGSAKLRWFVERNLVTPEGKVVDLGCGRGGWSYYCGGLKNVKEVKGLTKGGPGHEEPIPMSTYGWNLVRLQSGVDVFFTPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESETPNLDIIGKRIEKIKQEHETSWHYDQDHPYKTWAYHGSYETKQTGSASSMVNGVVRLLTKPWDVIPMVTQMAMTDTTPFGQQRVFKEKVDTRTQEPKEGTKKLMKITAEWLWKELGKKKTPRMCTREEFTRKVRSNAALGAIFTDENKWKSAREAVEDSGFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVVTYGLNTFTNMEAQLIRQMEGEGVFKSIQQLTVKEEIAVKNWLIRVGRERLSRMAISGDDCVVKPLDDRFASALTALNDMGKVRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWIPTSRTTWSIHATHEWMTTEDMLTVWNRVWIQENPWMEDKTPVESWEEIPYLGKREDQWCGSLIGLTSRATWAKNIQTAINQVRSLIGNEEYTDYMPSMKRFRREEEEAGVLW

SEQ ID NO: 3800 - protein, 3291 aa, Artificial Sequence
  derived and/or modified protein sequence (wt) from DENV-2__KM279517__SS-prME
TAGIIIMMIPTVMAFHLTTRNGEPHMIVSRQEKGKSLLFKTENGVNMCTLMAMDLGELCEDTITYNCPLLRQNEPEDIDCWCNSTSTWVTYGTCTATGEHRREKRSVALVPHVGMGLETRTETWMSSEGAWKHAQRIETWILRHPGFTIMAAILAYTIGTTYFQRVLIFILLTAVTPSMAMRCIGISNRDFVEGVSGGSWVDIVLEHGSCVTTMAKNKPTLDFELIKTEAKHLATLRKYCVEAKLTNTTTASRCPTQGEPSLNEEQDKRFVCKHSMVDRGWGNGCGLFGKGGIVTCAMFTCKKNMEGKVVQPENLEYTIVITPHSGEENAVGNDTGKHGKEIKVTPQSSITEAELTGYGTVTMECSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRHVLGRLITVNPIVTEKDSPVNIEAEPPFGDSYIIIGVEPGQLKLSWFKKGSSIGQMFETTMRGAKRMAILGDTAWDFGSLGGVFTSIGKALHQVFGAIYGAAFSGVSWTMKILIGVVITWIGMNSRSTSLSVSLVLVGVVTLYLGVMVQADSGCVVSWKNKELKCGSGIFITDNVHTWTEQYKFQPESPPKLASAIQKAHEEGICGIRSVTRLENLMWKQITPELNHILTENEVKLTIMTGDIKGIMQAGKRSLRPQPTELKYSWKAWGKAKMLSTELHNHTFLIDGPETAECPNTNRAWNSLEVEDYGFGVFTTNIWLKLKERQDVFCDSKLMSAAIKDNRAVHADMGYWIESALNDTWKIEKASFIEVKSCHWPKSHTLWSNGVLESEMIIPKNFAGPVSQHNYRPGYHTQTAGPWHLGRLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMTTIGIVLLSQSTIPESILELTDALALGMMVLKIVRNMEKYQLAVTIMAILCVPNAVILQNAWKVSCTTLAVVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVRWEEQAEISGSSPILSITISEDGSMSIKNEEEEQTLTILIRTGLLVISGLFPVSIPITAAAWYLWEVKKQRAGVLWDVPSPPPVGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIVDKKGKVVGLYGNGVVTRSGTYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPIRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYIKTRTNDWDFVVTTDISEMGANFKAERVIDPRRCMKPVILTDGEERVILAGPMPVTHSSAAQRRGRVGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGVKNNQILEENVEVEIWTKEGERKKLKPRWLDARIYSDPLALKEFKEFAAGRKSLTLNLITEMGRLPTFMTQKAKNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDFGLGSITTQQPESNILDIDLRPASAWTLYAVATTFITPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGMTVIDLDPIPYDPKFEKQLGQVMLLVLCVTQVLMMRTTWALCEALTLATGPISTLWEGNPGRFWNTTIAVSMANIFRGSYLAGAGLLFSIMKNTANTRRGTGNTGETLGEKWKNRLNALGKSEFQIYKKSGIQEVDRTLAKEGIKRGETDHHAVSRGSAKLRWFVERNLVTPEGKVVDLGCGRGGWSYYCGGLKNVKEVKGLTKGGPGHEEPIPMSTYGWNLVRLQSGVDVFFTPPEKCDTLLCDIGESSPNPTVEAGRTLRVLNLVENWLNNNTQFCIKVLNPYMPSVIEKMETLQRKYGGALVRNPLSRNSTHEMYWVSNASGNIVSSVNMISRMLINRFTMRHKKATYEPDVDLGSGTRNIGIESETPNLDIIGKRIEKIKQEHETSWHYDQDHPYKTWAYHGSYETKQTGSASSMVNGVVRLLTKPWDVIPMVTQMAMTDTTPFGQQRVFKEKVDTRTQEPKEGTKKLMKITAEWLWKELGKKKTPRMCTREEFTRKVRSNAALGAIFTDENKWKSAREAVEDSGFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVVTYGLNTFTNMEAQLIRQMEGEGVFKSIQQLTVKEEIAVKNWLIRVGRERLSRMAISGDDCVVKPLDDRFASALTALNDMGKVRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWIPTSRTTWSIHATHEWMTTEDMLTVWNRVWIQENPWMEDKTPVESWEEIPYLGKREDQWCGSLIGLTSRATWAKNIQTAINQVRSLIGNEEYTDYMPSMKRFRREEEEAGVLW

SEQ ID NO: 3801 - protein, 3291 aa, Artificial Sequence
  derived and/or modified protein sequence (wt) from DENV-2__KM279518__SS-prME
TAGIIIMMIPTVMAFHLTTRNGEPHMIVSRQEKGKSLLFKTENGVNMCTLMAMDLGELCEDTITYNCPLLRQNEPEDIDCWCNSTSTWVTYGTCTATGEHRREKRSVALVPHVGMGLETRTETWMSSEGAWKHAQRIETWILRHPGFTIMAAILAYTIGTTYFQRVLIFILLTAVTPSMAMRCIGISNRDFVEGVSGGSWVDIVLEHGSCVTTMAKNKPTLDFELIKTEAKHLATLRKYCVEAKLTNTTTASRCPTQGEPSLNEEQDKRFVCKHSMVDRGWGNGCGLFGKGGIVTCAMFTCKKNMEGKVVQPENLEYTIVITPHSGEENAVGNDTGKHGKEIKVTPQSSITEAELTGYGTVTMECSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRHVLGRLITVNPIVTEKDSPVNIEAEPPFGDSYIIIGVEPGQLKLSWFKKGSSIGQMFETTMRGAKRMAILGDTAWDFGSLGGVFTSIGKALHQVFGAIYGAAFSGVSWTMKILIGVVITWIGMNSRSTSLSVSLVLVGVVTLYLGVMVQADSGCVVSWKNKELKCGSGIFITDNVHTWTEQYKFQPESPSKLASAIQKAHEEGICGIRSVTRLENLMWKQITPELNHILTENEVKLTIMTGDIKGIMQAGKRSLRPQPTELKYSWKAWGKAKMLSTELHNHTFLIDGPETAECPNTNRAWNSLEVEDYGFGVFTTNIWLKLKERQDVFCDSKLMSAAIKDNRAVHADMGYWIESALNDTWKIEKASFIEVKSCHWPKSHTLWSNGVLESEMIIPKNFAGPVSQHNYRPGYHTQTAGPWHLGRLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMTTIGIVLLSQSTIPESILELTDALALGMMVLKIVRNMEKYQLAVTIMAILCVPNAVILQNAWKVSCTTLAVVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVRWEEQAEISGSSPILSITISEDGSMSIKNEEEEQTLTILIRTGLLVISGLFPVSIPITAAAWYLWEVKKQRAGVLWDVPSPPPVGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIVDKKGKVVGLYGNGVVTRSGTYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPIRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYIKTRTNDWDFVVTTDISEMGANFKAERVIDPRRCMKPVILTDGEERVILAGPMPVTHSSAAQRRGRVGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGVKNNQILEENVEVEIWTKEGERKKLKPRWLDARIYSDPLALKEFKEFAAGRKSLTLNLITEMGRLPTFMTQKAKNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDFGLGSITTQQPESNILDIDLRPASAWTLYAVATTFITPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGMTVIDLDPIPYDPKFEKQLGQVMLLVLCVTQVLMMRTTWALCEALTLATGPISTLWEGNPGRFWNTTIAVSMANIFRGSYLAGAGLLFSIMKNTANTRRGTGNTGETLGEKWKNRLNALGKSEFQIYKKSGIQEVDRTLAKEGIKRGETDHHAVSRGSAKLRWFVERNLVTPEGKVVDLGCGRGGWSYYCGGLKNVKEVKGLTKGGPGHEEPIPMSTYGWNLVRLQSGVDVFFTPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESETPNLDIIGKRIEKIKQEHETSWHYDQDHPYKTWAYHGSYETKQTGSASSMVNGVVRLLTKPWDVIPMVTQMAMTDTTPFGQQRVFKEKVDTRTQEPKEGTKKLMKITAEWLWKELGKKKTPRMCTREEFTRKVRSNAALGAIFTDENKWKSAREAVEDSGFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRQTPRGTVMDIISRRDQRGSGQVVTYGLNTFTNMEAQLIRQMEGEGVFKSIQQLTVKEEIAVKNWLIRVGRERLSRMAISGDDCVVKPLDDRFASALTALNDMGKVRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWIPTSRTTWSIHATHEWMTTEDMLTVWNRVWIQENPWMEDKTPVESWEEIPYLGKREDQWCGSLIGLTSRATWAKNIQTAINQVRSLIGNEEYTDYMPSMKRFRREEEEAGVLW

SEQ ID NO: 3802 - protein, 3291 aa, Artificial Sequence
  derived and/or modified protein sequence (wt) from DENV-2__KM279519__SS-prME
TAGIIIMMIPTVMAFHLTTRNGEPHMIVSRQEKGKSLLFKTENGVNMCTLMAMDLGELCEDTITYNCPLLRQNEPEDIDCWCNSTSTWVTYGTCTATGEHRREKRSVALVPHVGMGLETRTETWMSSEGAWKHAQRIETWILRHPGFTIMAAILAYTIGTTYFQRVLIFILLTAVTPSMAMRCIGISNRDFVEGVSGGSWVDIVLEHGSCVTTMAKNKPTLDFELIKTEAKHLATLRKYCVEAKLTNTTTASRCPTQGEPSLNEEQDKRFVCKHSMVDRGWGNGCGLFGKGGIVTCAMFTCKKNMEGKVVQPENLEYTIVITPHSGEENAVGNDTGKHGKEIKVTPQSSITEAELTGYGTVTMECSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRHVLGRLITVNPIVTEKDSPVNIEAEPPFGDSYIIIGVEPGQLKLSWFKKGSSIGQMFETTMRGAKRMAILGDTAWDFGSLGGVFTSIGKALHQVFGAIYGAAFSGVSWTMKILIGVVITWIGMNSRSTSLSVSLVLVGVVTLYLGVMVQADSGCVVSWKNKELKCGSGIFITDNVHTWTEQYKFQPESPSKLASAIQKAHEEGICGIRSVTRLENLMWKQITPELNHILTENEVKLTIMTGDIKGIMQAGKRSLRPQPTELKYSWKAWGKAKMLSTELHNHTFLIDGPETAECPNTNRAWNSLEVEDYGFGVFTTNIWLKLKERQDVFCDSKLMSAAIKDNRAVHADMGYWIESALNDTWKIEKASFIEVKSCHWPKSHTLWSNGVLESEMIIPKNFAGPVSQHNYRPGYHTQTAGPWHLGRLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMTTIGIVLLSQSTIPESILELTDALALGMMVLKIVRNMEKYQLAVTIMAILCVPNAVILQNAWKVSCTTLAVVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVRWEEQAEISGSSPILSITISEDGSMSIKNEEEEQTLTILIRTGLLVISGLFPVSIPITAAAWYLWEVKKQRAGVLWDVPSPPPVGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIVDKKGKVVGLYGNGVVTRSGTYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPIRVPNYNLIIMDEAHFTDPASIAARGYISTRVEMGEAAGIFMTATPPGSRDPFPQSNAPIMDEEKEIPERSWNSGHEWVTDFKGKTVWFVPSIKAGNDIAACLRKNGKKVIQLSRKTFDSEYIKTRTNDWDFVVTTDISEMGANFKAERVIDPRRCMKPVILTDGEERVILAGPMPVTHSSAAQRRGRVGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGVKNNQILEENVEVEIWTKEGERKKLKPRWLDARIYSDPLALKEFKEFAAGRKSLTLNLITEMGRLPTFMTQKAKNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDFGLGSITTQQPESNILDIDLRPASAWTLYAVATTFITPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGMTVIDLDPIPYDPKFEKQLGQVMLLVLCVTQVLMMRTTWALCEALTLATGPISTLWEGNPGRFWNTTIAVSMANIFRGSYLAGAGLLFSIMKNTANTRRGTGNTGETLGEKWKNRLNALGKSEFQIYKKSGIQEVDRTLAKEGIKRGETDHHAVSRGSAKLRWFVERNLVTPEGKVVDLGCGRGGWSYYCGGLKNVKEVKGLTKGGPGHEEPIPMSTYGWNLVRLQSGVDVFFTPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESETPNLDIIGKRIEKIKQEHETSWHYDQDHPYKTWAYHGSYETKQTGSASSMVNGVVRLLTKPWDVIPMVTQMAMTDTTPFGQQRVFKEKVDTRTQEPKEGTKKLMKITAEWLWKELGKKKTPRMCTREEFTRKVRSNAALGAIFTDENKWKSAREAVEDSGFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVVTYGLNTFTNMEAQLIRQMEGEGVFKSIQQLTVKEEIAVKNWLIRVGRERLSRMAISGDDCVVKPLDDRFASALTALNDMGKVRKDIQQWEPSRGWNDWTQVPFCSHHFHELIMKDGRVLAVPCRNQDELIGRARISQGAGWSLRETACLGKSYAQMWSLMYFHRRDLRLAANAICSAVPSHWIPTSRTTWSIHATHEWMTTEDMLTVWNRVWIQENPWMEDKTPVESWEEIPYLGKREDQWCGSLIGLTSRATWAKNIQTAINQVRSLIGNEEYTDYMPSMKRFRREEEEAGVLW

SEQ ID NO: 3803 - protein, 3291 aa, Artificial Sequence
  derived and/or modified protein sequence (wt) from DENV-2__KM279520__SS-prME
TAGIIIMMIPTVMAFHLTTRNGEPHMIVSRQEKGKSLLFKTENGVNMCTLMAMDLGELCEDTITYNCPLLRQNEPEDIDCWCNSTSTWVTYGTCTATGEHRREKRSVALVPHVGMGLETRTETWMSSEGAWKHAQRIETWILRHPGFTIMAAILAYTIGTTYFQRVLIFILLTAVTPSMAMRCIGISNRDFVEGVSGGSWVDIVLEHGSCVTTMARNKPTLDFELIKTEAKHLATLRKYCVEAKLTNTTTASRCPTQGEPSLNEEQDKRFVCKHSMVDRGWGNGCGLFGKGGIVTCAMFTCKKNMEGKVVQPENLEYTIVITPHSGEENAVGNDTGKHGKEIKVTPQSSITEAELTGYGTVTMECSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRHALGRLITVNPIVTEKDSPVNIEAEPPFGDSYIIIGVEPGQLKLSWFKKGSSIGQMFETTMRGAKRMAILGDTAWDFGSLGGVFTSIGKALHQVFGAIYGAAFSGVSWTMKILIGVVITWIGMNSRSTSLSVSLVLVGVVTLYLGVMVQADSGCVVSWKNKELKCGSGIFITDNVHTWTEQYKFQPESPSKLASAIQKAHEEGICGIRSVTRLENLMWKQITPELNHILTENEVKLTIMTGDIKGIMQAGKRSLRPQPTELKYSWKAWGKAKMLSTELHNHTFLIDGPETAECPNTNRAWNSLEVEDYGFGVFTTNIWLKLKERQDVFCDSKLMSAAIKDNRAVHADMGYWIESALNDTWKIEKASFIEVKSCHWPKSHTLWSNGVLESEMIIPKNFAGPVSQHNYRPGYHTQTAGPWHLGRLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMTTIGIVLLSQSTIPESILELTDALALGMMVLKIVRNMEKYQLAVTIMAILCVPNAVILQNAWKVSCTTLAVVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVRWEEQAEISGSSPILSITISEDGSMSIKNEEEEQTLTILIRTGLLVISGLFPVSIPITAAAWYLWEVKKQRAGVLWDVPSPPPVGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIVDKKGKVVGLYGNGVVTRSGTYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPIRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYIKTRTNDWDFVVTTDISEMGANFKAERVIDPRRCMKPVILTDGEERVILAGPMPVTHSSAAQRRGRVGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGVKNNQILEENVEVEIWTKEGERKKLKPRWLDARIYSDPLALKEFKEFAAGRKSLTLNLITEMGRLPTFMTQKAKNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDFGLGSITTQQPESNILDIDLRPASAWTLYAVATTFITPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGMTVIDLDPIPYDPKFEKQLGQVMLLVLCVTQVLMMRTTWALCEALTLATGPISTLWEGNPGRFWNTTIAVSMANIFRGSYLAGAGLLFSIMKNTANTRRGTGNTGETLGEKWKNRLNALGKSEFQIYKKSGIQEVDRTLAKEGIKRGETDHHAVSRGSAKLRWFVERNLVTPEGKVVDLGCGRGGWSYYCGGLKNVKEVKGLTKGGPGHEEPIPMSTYGWNLVRLQSGVDVFFTPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESETPNLDIIGKRIEKIKQEHETSWHYDQDHPYKTWAYHGSYETKQTGSASSMVNGVVRLLTKPWDVIPMVTQMAMTDTTPFGQQRVFKEKVDTRTQEPKEGTKKLMKITAEWLWKELGKKKTPRMCTREEFTRKVRSNAALGAIFTDENKWKSAREAVEDSGFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVVTYGLNTFTNMEAQLIRQMEGEGVFKSIQQLTVKEEIAVKNWLIRVGRERLSRMAISGDDCVVKPLDDRFASALTALNDMGKVRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWIPTSRTTWSIHATHEWMTTEDMLTVWNRVWIQENPWMEDKTPVETWEEIPYLGKREDQWCGSLIGLTSRATWAKNIQTAINQVRSLIGNEEYTDYMPSMKRFRREEEEAGVLW

SEQ ID NO: 3804 - protein, 3291 aa, Artificial Sequence
  derived and/or modified protein sequence (wt) from DENV-2__KM279521__SS-prME
TAGIIIMMIPTVMAFHLTTRNGEPHMIVSRQEKGKSLLFKTENGVNMCTLMAMDLGELCEDTITYNCPLLRQNEPEDIDCWCNSTSTWVTYGTCTATGEHRREKRSVALVPHVGMGLETRTETWMSSEGAWKHAQRIETWILRHPGFTIMAAILAYTIGTTYFQRVLIFILLTAVTPSMAMRCIGISNRDFVEGVSGGSWVDIVLEHGSCVTTMAKNKPTLDFELIKTEAKHLATLRKYCVEAKLTNTTTASRCPTQGEPSLNEEQDKRFVCKHSMVDRGWGNGCGLFGKGGIVTCAMFTCKKNMEGKVVQPENLEYTIVITPHSGEENAVGNDTGKHGKEIKVTPQSSITEAELTGYGTVTMECSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRHVLGRLITVNPIVTEKDSTVNIEAEPPFGDSYIIIGVEPGQLKLSWFKKGSSIGQMFETTMRGAKRMAILGDTAWDFGSLGGVFTSIGKALHQVFGAIYGAAFSGVSWTMKILIGVVITWIGMNSRSTSLSVSLVLVGVVTLYLGVMVQADSGCVVSWKNKELKCGSGIFITDNVHTWTEQYKFQPESPSKLASAIQKAHEEGICGIRSVTRLENLMWKQITPELNHILTENEVKLTIMTGDIKGIMQAGKRSLRPQPTELKYSWKAWGKAKMLSTELHNHTFLIDGPETAECPNTNRAWNSLEVEDYGFGVFTTNIWLKLKERQDVFCDSKLMSAAIKDNRAVHADMGYWIESALNDTWKIEKASFIEVKSCHWPKSHTLWSNGVLESEMIIPKNFAGPVSQHNYRPGYHTQTAGPWHLGRLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMTTIGIVLLSQSTIPESILELTDALALGMMVLKIVRNMEKYQLAVTIMAILCVPNAVILQNAWKVSCTTLAVVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVRWEEQAEISGSSPILSITISEDGSMSIKNEEEEQTLTILIRTGLLVISGLFPVSIPITAAAWYLWEVKKQRAGVLWDVPSPPPVGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIVDKKGKVVGLYGNGVVTRSGTYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPIRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYIKTRTNDWDFVVTTDISEMGANFKAERVIDPRRCMKPVILTDGEERVILAGPMPVTHSSAAQRRGRVGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGVKNNQILEENVEVEIWTKEGERKKLKPRWLDARIYSDPLALKEFKEFAAGRKSLTLNLITEMGRLPTFMTQKAKNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDFGLGSITTQQPESNILDIDLRPASAWTLYAVATTFITPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGMTVIDLDPIPYDPKFEKQLGQVMLLVLCVTQVLMMRTTWALCEALTLATGPISTLWEGNPGRFWNTTIAVSMANIFRGSYLAGAGLLFSIMKNTANTRRGTGNTGETLGEKWKNRLNALGKSEFQIYKKSGIQEVDRTLAKEGIKRGETDHHAVSRGSAKLRWFVERNLVTPEGKVVDLGCGRGGWSYYCGGLKNVKEVKGLTKGGPGHEEPIPMSTYGWNLVRLQSGVDVFFTPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESETPNLDIIGKRIEKIKQEHETSWHYDQDHPYKTWAYHGSYETKQTGSASSMVNGVVRLLTKPWDVIPMVTQMAMTDTTPFGQQRVFKEKVDTRTQEPKEGTKKLMKITAEWLWKELGKKKTPRMCTREEFTRKVRSNAALGAIFTDENKWKSAREAVEDSGFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVVTYGLNTFTNMEAQLIRQMEGEGVFKSIQQLTVKEEIAVKNWLIRVGRERLSRMAISGDDCVVKPLDDRFASALTALNDMGKVRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWIPTSRTTWSIHATHEWMTTEDMLTVWNRVWIQENPWMEDKTPVESWEEIPYLGKREDQWCGSLIGLTSRATWAKNIQTAINQVRSLIGNEEYTDYMPSMKRFRREEEEAGVLW

SEQ ID NO: 3805 - protein, 3291 aa, Artificial Sequence
  derived and/or modified protein sequence (wt) from DENV-2__KM279583__SS-prME
TAGIIIMMIPTVMAFHLTTRNGEPHMIVSRQEKGKSLLFKTENGVNMCTLMAMDLGELCEDTITYNCPLLRQNEPEDIDCWCNSTSTWVTYGTCTATGEHRREKRSVALVPHVGMGLETRTETWMSSEGAWKHAQRIETWILRHPGFTIMAAILAYTIGTTYFQRVLIFILLTAVTPSMAMRCIGISNRDFVEGVSGGSWVDIVLEHGSCVTTMAKNKPTLDFELIKTEAKHLATLRKYCVEAKLTNTTTASRCPTQGEPSLNEEQDKRFVCKHSMVDRGWGNGCGLFGKGGIVTCAMFTCKKNMEGKVVQPENLEYTIVITPHSGEENAVGNDTGKHGKEIKVTPQSSITEAELTGYGTVTMECSPRTGLDFNEMALLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRHVLGRLITVNPIVTEKDSPVNIEAEPPFGDSYIIIGVEPGQLKLSWFKKGSSIGQMFETTMRGAKRMAILGDTAWDFGSLGGVFTSIGKALHQVFGAIYGAAFSGVSWTMKILIGVVITWIGMNSRSTSLSVSLVLVGVVTLYLGVMVQADSGCVVSWKNKELKCGSGIFITDNVHTWTEQYKFQPESPSKLASAIQKAHEEGICGIRSVTRLENLMWKQITPELNHILTENEVKLTIMTGDIKGIMQAGKRSLRPQPTELKYSWKAWGKAKMLSTELHNHTFLIDGPETAECPNTNRAWNSLEVEDYGFGVFTTNIWLKLKERQDVFCDSKLMSAAIKDNRAVHADMGYWIESALNDTWKIEKASFIEVKSCHWPKSHTLWSNGVLESEMIIPKNFAGPVSQHNYRPGYHTQTAGPWHLGRLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMTTIGIVLLSQSTIPESILELTDALALGMMVLKIVRNMEKYQLAVTIMAILCVPNAVILQNAWKVSCTTLAVVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVRWEEQAEISGSSPILSITISEDGSMSIKNEEEEQTLTILIRTGLLVISGLFPVSIPITAAAWYLWEVKKQRAGVLWDVPSPPPVGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIVDKKGKVVGLYGNGVVTRSGTYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPIRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYIKTRTNDWDFVVTTDISEMGANFKAERVIDPRRCMKPVILTDGEERVILAGPMPVTHSSAAQRRGRVGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGVKNNQILEENVEVEIWTKEGERKKLKPRWLDARIYSDPLALKEFKEFAAGRKSLTLNLITEMGRLPTFMTQKAKNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDFGLGSITTQQPESNILDIDLRPASAWTLYAVATTFITPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGMTVIDLDPIPYDPKFEKQLGQVMLLVLCVTQVLMMRTTWALCEALTLATGPISTLWEGNPGRFWNTTIAVSMANIFRGSYLAGAGLLFSIMKNTANTRRGTGNTGETLGEKWKNRLNALGKSEFQIYKKSGIQEVDRTLAKEGIKRGETDHHAVSRGSAKLRWFVERNLVTPEGKVVDLGCGRGGWSYYCGGLKNVKEVKGLTKGGPGHEEPIPMSTYGWNLVRLQSGVDVFFTPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESETPNLDIIGKRIEKIKQEHETSWHYDQDHPYKTWAYHGSYETKQTGSASSMVNGVVRLLTKPWDVIPMVTQMAMTDTTPFGQQRVFKEKVDTRTQEPKEGTKKLMKITAEWLWKELGKKKTPRMCTREEFTRKVRSNAALGAIFTDENKWKSAREAVEDSGFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVVTYGLNTFTNMEAQLIRQMEGEGVFKSIQQLTVKEEIAVKNWLIRVGRERLSRMAISGDDCVVKPLDDRFASALTALNDMGKVRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWIPTSRTTWSIHATHEWMTTEDMLTVWNRVWIQENPWMEDKTPVESWEEIPYLGKREDQWCGSLIGLTSRATWAKNIQTAINQVRSLIGNEEYTDYMPSMKRFRREEEEAGVLW

SEQ ID NO: 3806 - protein, 3291 aa, Artificial Sequence
  derived and/or modified protein sequence (wt) from DENV-2__KM279585__SS-prME
TAGIIIMMIPTVMAFHLTTRNGEPHMIVSRQEKGKSLLFKTENGVNMCTLMAMDLGELCEDTITYNCPLLRQNEPEDIDCWCNSTSTWVTYGTCTATGEHRREKRSVALVPHVGMGLETRTETWMSSEGAWKHAQRIETWILRHPGFTIMAAILAYTIGTTYFQRVLIFILLTAVTPSMAMRCIGISNRDFVEGVSGGSWVDIVLEHGSCVTTMAKNKPTLDFELIKTEAKHLATLRKYCVEAKLTNTTTASRCPTQGEPSLNEEQDKRFVCKHSMVDRGWGNGCGLFGKGGIVTCAMFTCKKNMEGKVVQPENLEYTIVITPHSGEENAVGNDTGKHGKEIKVTPQSSITEAELTGYGTVTMECSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVVRVQYEGDGSPCKIPFEIMDLEKRHVLGRLITVNPIVTEKDSPVNIEAEPPFGDSYIIIGVEPGQLKLSWFKKGSSIGQMFETTMRGAKRMAILGDTAWDFGSLGGVFTSIGKALHQVFGAIYGAAFSGVSWTMKILIGVVITWIGMNSRSTSLSVSLVLVGVVTLYLGVMVQADSGCVVSWKNKELKCGSGIFITDNVHTWTEQYKFQPESPSKLASAIQKAHEEGICGIRSVTRLENLMWKQITPELNHILTENEVKLTIMTGDIKGIMQAGKRSLRPQPTELKYSWKAWGKAKMLSTELHNHTFLIDGPETAECPNTNRAWNSLEVEDYGFGVFTTNIWLKLKERQDVFCDSKLMSAAIKDNRAVHADMGYWIESALNDTWKIEKASFIEVKSCHWPKSHTLWSNGVLESEMIIPKNFAGPVSQHNYRPGYHTQTAGPWHLGRLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMTTIGIVLLSQSTIPESILELTDALALGMMVLKIVRNMEKYQLAVTIMAILCVPNAVILQNAWKVSCTTLAVVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVRWEEQAEISGSSPILSITISEDGSMSIKNEEEEQTLTILIRTGLLVISGLFPVSIPITAAAWYLWEVKKQRAGVLWDVPSPPPVGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIVDKKGKVVGLYGNGVVTRSGTYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPIRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYIKTRTNDWDFVVTTDISEMGANFKAERVIDPRRCMKPVILTDGEERVILAGPMPVTHSSAAQRRGRVGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGVKNNQILEENVEVEIWTKEGERKKLKPRWLDARIYSDPLALKEFKEFAAGRKSLTLNLITEMGRLPTFMTQKAKNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDFGLGSITTQQPESNILDIDLRPASAWTLYAVATTFITPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGMTVIDLDPIPYDPKFEKQLGQVMLLVLCVTQVLMMRTTWALCEALTLATGPISTLWEGNPGRFWNTTIAVSMANIFRGSYLAGAGLLFSIMKNTANTRRGTGNTGETLGEKWKNRLNALGKSEFQIYKKSGIQEVDRTLAKEGIKRGETDHHAVSRGSAKLRWFVERNLVTPEGKVVDLGCGRGGWSYYCGGLKNVKEVKGLTKGGPGHEEPIPMSTYGWNLVRLQSGVDVFFTPPEKCDTLLCDIGESSPNPTVEAGRTLRVLNLVDNWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESETPNLDIIGKRIEKIKQEHETSWHYDQDHPYKTWAYHGSYETKQTGSASSMVNGVVRLLTKPWDVIPMVTQMAMTDTTPFGQQRVFKEKVDTRTQEPKEGTKKLMKITAEWLWKELGKKKTPRMCTREEFTRKVRSNAALGAIFTDENKWKSAREAVEDSGFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVVTYGLNTFTNMEAQLIRQMEGEGVFKSIQQLTVKEEIAVKNWLIRVGRERLSRMAISGDDCVVKPLDDRFASALTALNDMGKVRKDIQQWEPSRGWNDWTQVPFCSHHFHELIMKDGRVLVVPCRNQDELIGRARISQGAGWSLRETACLGKSYAQMWNLMYFHRRDLRLAANAICSAVPSHWIPTSRTTWSIHATHEWMTTEDMLTVWNRVWIQENPWMEDKTPVESWEEIPYLGKREDQWCGSLIGLTSRATWAKNIQTAINQVRSLIGNEEYTDYMPSMKRFRREEEEAGVLW

SEQ ID NO: 3807 - protein, 3291 aa, Artificial Sequence
  derived and/or modified protein sequence (wt) from DENV-2__KM279525__SS-prME
TAGIIIMMIPTVMAFHLTTRNGEPHMIVSRQEKGKSLLFKTENGVNMCTLMAMDLGELCEDTITYNCPLLRQNEPEDIDCWCNSTSTWVTYGTCTATGEHRREKRSVALVPHVGMGLETRTETWMSSEGAWKHAQRIETWILRHPGFTIMAAILAYTIGTTYFQRVLIFILLTAVTPSMAMRCIGISNRDFVEGVSGGSWVDIVLEHGSCVTTMAKNKPTLDFELIKTEAKHLATLRKYCVEAKLTNTTTASRCPTQGEPSLNEEQDKRFVCKHSMVDRGWGNGCGLFGKGGIVTCAMFTCKKNMEGKVVQPENLEYTIVITPHSGEENAVGNDTGKHGKEIKVTPQSSITEAELTGYGTVTMECSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRHVLGRLITVNPIVTEKDSPVNIEAEPPFGDSYIIIGVEPGQLKLSWFKKGSSIGQMFETTMRGAKRMAILGDTAWDFGSLGGVFTSIGKALHQVFGAIYGAAFSGVSWTMKILIGVVITWIGMNSRSTSLSVSLVLVGVVTLYLGVMVQADSGCVVSWKNKELKCGSGIFITDNVHTWTEQYKFQPESPSKLASAIQKAHEEGICGIRSVTRLENLMWKQITPELNHILTENEVKLTIMTGDIKGIMQAGKRSLRPQPTELKYSWKAWGKAKMLSTELHNHTFLIDGPETAECPNTNRAWNSLEVEDYGFGVFTTNIWLKLKERQDVFCDSKLMSAAIKDNRAVHADMGYWIESALNDTWKIEKASFIEVKSCHWPKSHTLWSNGVLESEMIIPKNFAGPVSQHNYRPGYHTQTAGPWHLGRLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVILITGNMSFRDLGRVMVMVGATMTDDIGMGVTYLALLAAFKVRPTFAAGLLLRKLTSKELMMTTIGIVLLSQSTIPENILELTDALALGMMVLKIVRNMEKYQLAVTIMAILCVPNAVILQNAWKVSCTTLAVVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVRWEEQAEISGSSPILSITISEDGSMSIKNEEEEQTLTILIRTGLLVISGLFPVSIPITAAAWYLWEVKKQRAGVLWDVPSPPPVGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIVDKKGKVVGLYGNGVVTRSGTYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPIRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYIKTRTNDWDFVVTTDISEMGANFKAERVIDPRRCMKPVILTDGEERVILAGPMPVTHSSAAQRRGRVGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGVKNNQILEENVEVEIWTKEGERKKLKPRWLDARIYSDPLALKEFKEFAAGRKSLTLNLITEMGRLPTFMTQKAKNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDFGLGSITTQQPESNILDIDLRPASAWTLYAVATTFITPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGMTVIDLDPIPYDPKFEKQLGQVMLLVLCVTQVLMMRTTWALCEALTLATGPISTLWEGNPGRFWNTTIAVSMANIFRGSYLAGAGLLFSIMKNTANTRRGTGNTGETLGEKWKNRLNALGKSEFQIYKKSGIQEVDRTLAKEGIKRGETDHHAVSRGSAKLRWFVERNLVTPEGKVVDLGCGRGGWSYYCGGLKNVKEVKGLTKGGPGHEEPIPMSTYGWNLVRLQSGVDVFFTPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESETPNLDIIGKRIEKIKQEHETSWHYDQDHPYKTWAYHGSYETKQTGSASSMVNGVVRLLTKPWDVIPMVTQMAMTDTTPFGQQRVFKEKVDTRTQEPKEGTKKLMKITAEWLWKELGKKKTPRMCTREEFTRKVRSNAALGAIFTDENKWKSAREAVEDSGFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVVTYGLNTFTNMEAQLIRQMEGEGVFKSIQQLTVKEEIAVKNWLIRVGRERLSRMAISGDDCVVKPLDDRFASALTALNDMGKVRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWIPTSRTTWSIHATHEWMTTEDMLTVWNRVWIQENPWMEDKTPVESWEEIPYLGKREDQWCGSLIGLTSRATWAKNIQTAINQVRSLIGNEEYTDYMPSMKRFRREEEEAGVLW

SEQ ID NO: 3808 - protein, 3291 aa, Artificial Sequence
  derived and/or modified protein sequence (wt) from DENV-2__KM279528__SS-prME
TAGIIIMMIPTVMAFHLTTRNGEPHMIVSRQEKGKSLLFKTENGVNMCTLMAMDLGELCEDTITYNCPLLRQNEPEDIDCWCNSTSTWVTYGTCTATGEHRREKRSVALVPHVGMGLETRTETWMSSEGAWKHAQRIETWILRHPGFTIMAAILAYTIGTTYFQRVLIFILLTAVTPSMAMRCIGISNRDFVEGVSGGSWVDIVLEHGSCVTTMAKNKPTLDFELIKTEAKHLATLRKYCVEAKLTNTTTASRCPTQGEPSLNEEQDKRFVCKHSMVDRGWGNGCGLFGKGGIVTCAMFTCKKNMEGKVVQPENLEYTIVITPHSGEENAVGNDTGKHGKEIKVTPQSSITEAELTGYGTVTMECSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRHVLGRLITVNPIVTEKDSPVNIEAEPPFGDSYIIIGVEPGQLKLSWFKKGSSIGQMFETTMRGAKRMAILGDTAWDFGSLGGVFTSIGKALHQVFGAIYGAAFSGVSWTMKILIGVVITWIGMNSRSTSLSVSLVLVGVVTLYLGVMVQADSGCVVSWKNKELKCGSGIFITDNVHTWTEQYKFQPESPSKLASAIQKAHEEGICGIRSVTRLENLMWKQITPELNHILTENEVKLTIMTGDIKGIMQAGKRSLRPQPTELKYSWKAWGKAKMLSTELHNHTFLIDGPETAECPNTNRAWNSLEVEDYGFGVFTTNIWLKLKERQDVFCDSKLMSAAIKDNRAVHADMGYWIESALNDTWKIEKASFIEVKSCHWPKSHTLWSNGVLESEMIIPKNFAGPVSQHNYRPGYHTQTAGPWHLGRLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMTTIGIVLLSQSTIPKSILELTDALALGMMVLKIVRNMEKYQLAVTIMAILCVPNAVILQNAWKVSCTTLAVVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVRWEEQAEISGSSPILSITISEDGSMSIKNEEEEQTLTILIRTGLLVISGLFPVSIPITAAAWYLWEVKKQRAGVLWDVPSPPPVGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIVDKKGKVVGLYGNGVVTRSGTYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPIRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYIKTRTNDWDFVVTTDISEMGANFKAERVIDPRRCMKPVILTDGEERVILAGPMPVTHSSAAQRRGRVGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGVKNNQILEENVEVEIWTKEGERKKLKPRWLDARIYSDPLALKEFKEFAAGRKSLTLNLITEMGRLPTFMTQKAKNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDFGLGSITTQQPESNILDIDLRPASAWTLYAVATTFITPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGMTVIDLDPIPYDPKFEKQLGQVMLLVLCVTQVLMMRTTWALCEALTLATGPISTLWEGNPGRFWNTTIAVSMANIFRGSYLAGAGLLFSIMKNTANTRRGTGNTGETLGEKWKNRLNALGKSEFQIYKKSGIQEVDRTLAKEGIKRGETDHHAVSRGSAKLRWFVERNLVTPEGKVVDLGCGRGGWSYYCGGLKNVKEVKGLTKGGPGHEEPIPMSTYGWNLVRLQSGVDVFFTPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESETPNLDIIGKRIEKIKQEHETSWHYDQDHPYKTWAYHGSYETKQTGSASSMVNGVVRLLTKPWDVIPMVTQMAMTDTTPFGQQRVFKEKVDTRTQEPKEGTKKLMKITAEWLWKELGKKKTPRMCTREEFTRKVRSNAALGAIFTDENKWKSAREAVEDSGFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVVTYGLNTFTNMEAQLIRQMEGEGVFKSIQQLTVKEEIAVKNWLIRVGRERLSRMAISGDDCVVKPLDDRFASALTALNDMGKVRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWIPTSRTTWSIHATHEWMTTEDMLTVWNRVWIQENPWMEDKTPVESWEEIPYLGKREDQWCGSLIGLTSRATWAKNIQTAINQVRSLIGNEEYTDYMPSMKRFRREEEEAGVLW

SEQ ID NO: 3809 - protein, 3291 aa, Artificial Sequence
  derived and/or modified protein sequence (wt) from DENV-2__KM279533__SS-prME
TAGIIIMMIPTVMAFHLTTRNGEPHMIVSRQEKGKSLLFKTENGVNMCTLMAMDLGELCEDTITYNCPLLRQNEPEDIDCWCNSTSTWVTYGTCTATGEHRREKRSVALVPHVGMGLETRTETWMSSEGAWKHAQRIETWILRHPGFTIMAAILAYTIGTTYFQRVLIFILLTAVTPSMAMRCIGISNRDFVEGVSGGSWVDIVLEHGSCVTTMAKNKPTLDFELIKTEAKHLATLRKYCVEAKLTNTTTASRCPTQGEPSLNEEQDKRFVCKHSMVDRGWGNGCGLFGKGGIVTCAMFTCKKNMEGKVVQPENLEYTIVITPHSGEENAVGNDTGKHGKEIKVTPQSSITEAELTGYGTVTMECSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRHVLGRLITVNPIVTEKDSPVNIEAEPPFGDSYIIIGVEPGQLKLSWFKKGSSIGQMFETTMRGAKRMAILGDTAWDFGSLGGVFTSIGKALHQVFGAIYGAAFSGVSWTMKILIGVVITWIGMNSRSTSLSVSLVLVGVVTLYLGVMVQADSGCVVSWKNKELKCGSGIFITDNVHTWTEQYKFQPESPSKLASAIQKAHEEGICGIRSVTRLENLMWKQITPELNHILTENEVKLTIMTGDIKGIMQAGKRSLRPQPTELKYSWKAWGKAKMLSTELHNHTFLIDGPETAECPNTNRAWNSLEVEDYGFGVFTTNIWLKLKERQDVFCDSKLMSAAIKDNRAVHADMGYWIESALNDTWKIEKASFIEVKSCHWPKSHTLWSNGVLESEMIIPKNFAGPVSQHNYRPGYHTQTAGPWHLGRLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMTTIGIVLLSQSTIPESILELTDALALGMMVLKIVRNMEKYQLAVTIMAILCVPNAVILQNAWKVSCTTLAVVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVRWEEQAEISGSSPILSITISEDGSMSIKNEEEEQTLTILIRTGLLVISGLFPVSIPITAAAWYLWEVKKQRAGVLWDVPSPPPVGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIVDKKGKVVGLYGNGVVTRSGTYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPIRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYIKTRTNDWDFVVTTDISEMGANFKAERVIDPRRCMKPVILTDGEERVILAGPMPVTHSSAAQRRGRVGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGVKNNQILEENVEVEIWTKEGERKKLKPRWLDARIYSDPLALKEFKEFAAGRKSLTLNLITEMGRLPTFMTQKAKNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDFGLGSITTQQPESNILDIDLRPASAWTLYAVATTFITPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGMTVIDLDPIPYDPKFEKQLGQVMLLVLCVTQVLMMRTTWALCEALTLATGPISTLWEGNPGRFWNTTIAVSMANIFRGSYLAGAGLLFSIMKNTANTRRGTGNTGETLGEKWKNRLNALGKSEFQIYKKSGIQEVDRTLAKEGIKRGETDHHAVSRGSAKLRWFVERNLVTPEGKVVDLGCGRGGWSYYCGGLKNVKEVKGLTKGGPGHEEPIPMSTYGWNLVRLQSGVDVFFTPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESETPNLDIIGKRIEKIKQEHETSWHYDQDHPYKTWAYHGSYETKQTGSASSMVNGVVRLLTKPWDVIPMVTQMAMTDTTPFGQQRVFKEKVDTRTQEPKEGTKKLMKITAEWLWKELGKKKTPRMCTREEFTRKVRSNAALGAIFTDENKWKSAREAVEDSGFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVVTYGLNTFTNMEAQLIRQMEGEGVFKSIQQLTVKEEIAVKNWLIRVGRERLSRMAISGDDCVVKPLDDRFASALTALNDMGKVRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWIPTSRTTWSIHATHEWMTTENMLTVWNRVWIQENPWMEDKTPVESWEEIPYLGKREDQWCGSLIGLTSRATWAKNIQTAINQVRSLIGNEEYTDYMPSMKRFRREEEEAGVLW

SEQ ID NO: 3810 - protein, 3291 aa, Artificial Sequence
  derived and/or modified protein sequence (wt) from DENV-2__KM279535__SS-prME
TAGIIIMMIPTVMAFHLTTRNGEPHMIVSRQEKGKSLLFKTENGVNMCTLMAMDLGELCEDTITYNCPLLRQNEPEDIDCWCNSTSTWVTYGTCTATGEHRREKRSVALVPHVGMGLETRTETWMSSEGAWKHAQRIETWILRHPGFTIMAAILAYTIGTTYFQRVLIFILLTAVTPSMAMRCIGISNRDFVEGVSGGSWVDIVLEHGSCVTTMAKNKPTLDFELIKTEAKHLATLRKYCVEAKLTNTTTASRCPTQGEPSLNEEQDKRFVCKHSMVDRGWGNGCGLFGKGGIVTCAMFTCKKNMEGKVVQPENLEYTIVITPHSGEENAVGNDTGKHGKEIKVTPQSSITEAELTGYGTVTMECSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRHVLGRLITVNPIVTEKDSPVNIEAEPPFGDSYIIIGVEPGQLKLSWFKKGSSIGQMFETTMRGAKRMAILGDTAWDFGSLGGVFTSIGKALHQVFGAIYGAAFSGVSWTMKILIGVVITWIGMNSRSTSLSVSLVLVGVVTLYLGVMVQADSGCVVSWKNKELKCGSGIFITDNVHTWTEQYKFQPESPSKLASAIQKAHEEGICGIRSVTRLENLMWKQITPELNHILTENEVKLTIMTGDIKGIMQAGKRSLRPQPTELKYSWKAWGKAKMLSTELHNHTFLIDGPETAECPNTNRAWNSLEVEDYGFGVFTTNIWLKLKERQDVFCDSKLMSAAIKDNRAVHADMGYWIESALNDTWKIEKASFIEVKSCHWPKSHTLWSNGVLESEMIIPKNFAGPVSQHNYRPGYHTQTAGPWHLGRLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMTTIGIVLLSQSTIPESILELTDALALGMMVLKIVRNMEKYQLAVTIMAISCVPNAVILQNAWKVSCTTLAVVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVRWEEQAEISGSSPILSITISEDGSMSIKNEEEEQTLTILIRTGLLVISGLFPVSIPITAAAWYLWEVKKQRAGVLWDVPSPPPVGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIVDKKGKVVGLYGNGVVTRSGTYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPIRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYIKTRTNDWDFVVTTDISEMGANFKAERVIDPRRCMKPVILTDGEERVILAGPMPVTHSSAAQRRGRVGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGVKNNQILEENVEVEIWTKEGERKKLKPRWLDARIYSDPLALKEFKEFAAGRKSLTLNLITEMGRLPTFMTQKAKNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDFGLGSITTQQPESNILDIDLRPASAWTLYAVATTFITPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGMTVIDLDPIPYDPKFEKQLGQVMLLVLCVTQVLMMRTTWALCEALTLATGPISTLWEGNPGRFWNTTIAVSMANIFRGSYLAGAGLLFSIMKNTANTRRGTGNTGETLGEKWKNRLNALGKSEFQIYKKSGIQEVDRTLAKEGIKRGETDHHAVSRGSAKLRWFVERNLVTPEGKVVDLGCGRGGWSYYCGGLKNVKEVKGLTKGGPGHEEPIPMSTYGWNLVRLQSGVDVFFTPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESETPNLDIIGKRIEKIKQEHETSWHYDQDHPYKTWAYHGSYETKQTGSASSMVNGVVRLLTKPWDVIPMVTQMAMTDTTPFGQQRVFKEKVDTRTQEPKEGTKKLMKITAEWLWKELGKKKTPRMCTREEFTRKVRSNAALGAIFTDENKWKSAREAVEDSGFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVVTYGLNTFTNMEAQLIRQMEGEGVFKSIQQLTVKEEIAVKNWLIRVGRERLSRMAISGDDCVVKPLDDRFASALTALNDMGKVRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWIPTSRTTWSIHATHEWMTTEDMLTVWNRVWIQENPWMEDKTPVESWEEIPYLGKREDQWCGSLIGLTSRATWAKNIQTAINQVRSLIGNEEYTDYMPSMKRFRREEEEAGVLW

SEQ ID NO: 3811 - protein, 3291 aa, Artificial Sequence
  derived and/or modified protein sequence (wt) from DENV-2__KM279539__SS-prME
TAGIIIMMIPTVMAFHLTTRNGEPHMIVSRQEKGKSLLFKTENGVNMCTLMAMDLGELCEDTITYNCPLLRQNEPEDIDCWCNSTSTWVTYGTCTATGEHRREKRSVALVPHVGMGLETRTETWMSSEGAWKHAQRIETWILRHPGFTIMAAILAYTIGTTYFQRVLIFILLTAVTPSMAMRCIGISNRDFVEGVSGGSWVDIVLEHGSCVTTMAKNKPTLDFELIKTEAKHLATLRKYCVEAKLTNTTTASRCPTQGEPSLNEEQDKRFVCKHSMVDRGWGNGCGLFGKGGIVTCAMFTCKKNMEGKVVQPENLEYTIVITPHSGEENAVGNDTGKHGKEIKVTPQSSITEAELTGYGTVTMECSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRHVLGRLITVNPIVTEKDSPVNIEAEPPFGDSYIIIGVEPGQLKLSWFKKGSSIGQMFETTMRGAKRMAILGDTAWDFGSLGGVFTSIGKALHQVFGAIYGAAFSGVSWTMKILIGVVITWIGMNSRSTSLSVSLVLVGVVTLYLGVMVQADSGCVVSWKNKELKCGSGIFITDNVHTWTEQYKFQPESPSKLASAIQKAHEEGICGIRSVTRLENLMWKQITPELNHILTENEVKLTIMTGDIKGIMQAGKRSLRPQPTELKYSWKAWGKAKMLSTELHNHTFLIDGPETAECPNTNRAWNSLEVEDYGFGVFTTNIWLKLKERQDVFCDSKLMSAAIKDNRAVHADMGYWIESALNDTWKIEKASFIEVKSCHWPKSHTLWSNGVLESEMIIPKNFAGPVSQHNYRPGYHTQTAGPWHLGRLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMTTIGIVLLSQSTIPESILELTDALALGMMVLKIVRNMEKYQLAVTIMAILCVPNAVILQNAWKVSCTTLAVVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVRWEEQAEISGSSPILSITISEDGSMSIKNEEEEQTLTILIRTGLLVISGLFPVSIPITAAAWYLWEVKKQRAGVLWDVPSPPPVGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIVDKKGKVVGLYGNGVVTRSGTYVSAIAQTEESIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPIRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYIKTRTNDWDFVVTTDISEMGANFKAERVIDPRRCMKPVILTDGEERVILAGPMPVTHSSAAQRRGRVGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGVKNNQILEENVEVEIWTKEGERKKLKPRWLDARIYSDPLALKEFKEFAAGRKSLTLNLITEMGRLPTFMTQKAKNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDFGLGSITTQQPESNILDIDLRPASAWTLYAVATTFITPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGMTVIDLDPIPYDPKFEKQLGQVMLLVLCVTQVLMMRTTWALCEALTLATGPISTLWEGNPGRFWNTTIAVSMANIFRGSYLAGAGLLFSIMKNTANTRRGTGNTGETLGEKWKNRLNALGKSEFQIYKKSGIQEVDRTLAKEGIKRGETDHHAVSRGSAKLRWFVERNLVTPEGKVVDLGCGRGGWSYYCGGLKNVKEVKGLTKGGPGHEEPIPMSTYGWNLVRLQSGVDVFFTPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESETPNLDIIGKRIEKIKQEHETSWHYDQDHPYKTWAYHGSYETKQTGSASSMVNGVVRLLTKPWDVIPMVTQMAMTDTTPFGQQRVFKEKVDTRTQEPKEGTKKLMKITAEWLWKELGKKKTPRMCTREEFTRKVRSNAALGAIFTDENKWKSAREAVEDSGFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVVTYGLNTFTNMEAQLIRQMEGEGVFKSIQQLTVKEEIAVKNWLIRVGRERLSRMAISGDDCVVKPLDDRFASALTALNDMGKVRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWIPTSRTTWSIHATHEWMTTEDMLTVWNRVWIQENPWMEDKTPVESWEEIPYLGKREDQWCGSLIGLTSRATWAKNIQTAINQVRSLIGNEEYTDYMPSMKRFRREEEEAGVLW

SEQ ID NO: 3812 - protein, 3291 aa, Artificial Sequence
  derived and/or modified protein sequence (wt) from DENV-2__KM279543__SS-prME
TAGIIIMMIPTVMAFHLTTRNGEPHMIVSRQEKGKSLLFKTENGVNMCTLMAMDLGELCEDTITYNCPLLRQNEPEDIDCWCNSTSTWVTYGTCTATGEHRREKRSVALVPHVGMGLETRTETWMSSEGAWKHAQRIETWILRHPGFTIMAAILAYTIGTTYFQRVLIFILLTAVTPSMAMRCIGISNRDFVEGVSGGSWVDIVLEHGSCVTTMAKNKPTLDFELIKTEAKHLATLRKYCVEAKLTNTTTASRCPTQGEPSLNEEQDKRFVCKHSMVDRGWGNGCGLFGKGGIVTCAMFTCKKNMEGKVVQPENLEYTIVITPHSGEENAVGNDTGKHGKEIKVTPQSSITEAELTGYGTVTMECSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRHVLGRLITVNPIVTEKDSPVNIEAEPPFGDSYIIIGVEPGQLKLSWFKKGSSIGQMFETTMRGAKRMAILGDTAWDFGSLGGMFTSIGKALHQVFGAIYGAAFSGVSWTMKILIGVVITWIGMNSRSTSLSVSLVLVGVVTLYLGVMVQADSGCVVSWKNKELKCGSGIFITDNVHTWTEQYKFQPESPSKLASAIQKAHEEGICGIRSVTRLENLMWKQITPELNHILTENEVKLTIMTGDIKGIMQAGKRSLRPQPTELKYSWKAWGKAKMLSTELHNHTFLIDGPETAECPNTNRAWNSLEVEDYGFGVFTTNIWLKLKERQDVFCDSKLMSAAIKDNRAVHADMGYWIESALNDTWKIEKASFIEVKSCHWPKSHTLWSNGVLESEMIIPKNFAGPVSQHNYRPGYHTQTAGPWHLGRLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMTTIGIVLLSQSTIPESILELTDALALGMMVLKIVRNMEKYQLAVTIMAILCVPNAVILQNAWKVSCTTLAVVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVRWEEQAEISGSSPILSITISEDGSMSIKNEEEEQTLTILIRTGLLVISGLFPVSIPITAAAWYLWEVKKQRAGVLWDVPSPPPVGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIVDKKGKVVGLYGNGVVTRSGTYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPIRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYIKTRTNDWDFVVTTDISEMGANFKAERVIDPRRCMKPVILTDGEERVILAGPMPVTHSSAAQRRGRVGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGVKNNQILEENVEVEIWTKEGERKKLKPRWLDARIYSDPLALKEFKEFAAGRKSLTLNLITEMGRLPTFMTQKAKNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDFGLGSITTQQPESNILDIDLRPASAWTLYAVATTFITPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGMTVIDLDPIPYDPKFEKQLGQVMLLVLCVTQVLMMRTTWALCEALTLATGPISTLWEGNPGRFWNTTIAVSMANIFRGSYLAGAGLLFSIMKNTANTRRGTGNTGETLGEKWKNRLNALGKSEFQIYKKSGIQEVDRTLAKEGIKRGETDHHAVSRGSAKLRWFVERNLVTPEGKVVDLGCGRGGWSYYCGGLKNVKEVKGLTKGGPGHEEPIPMSTYGWNLVRLQSGVDVFFTPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESETPNLDIIGKRIEKIKQEHETSWHYDQDHPYKTWAYHGSYETKQTGSASSMVNGVVRLLTKPWDVIPMVTQMAMTDTTPFGQQRVFKEKVDTRTQEPKEGTKKLMKITAEWLWKELGKKKTPRMCTREEFTRKVRSNAALGAIFTDENKWKSAREAVEDSGFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVVTYGLNTFTNMEAQLIRQMEGEGVFKSIQQLTVKEEIAVKNWLIRVGRERLSRMAISGDDCVVKPLDDRFASALTALNDMGKVRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWIPTSRTTWSIHATHEWMTTEDMLTVWNRVWIQENPWMEDKTPVESWEEIPYLGKREDQWCGSLIGLTSRATWAKNIQTAINQVRSLIGNEEYTDYMPSMKRFRREEEEAGVLW

SEQ ID NO: 3813 - protein, 3291 aa, Artificial Sequence
  derived and/or modified protein sequence (wt) from DENV-2__KM279571__SS-prME
TAGIIIMMIPTVMAFHLTTRNGEPHMIVSRQEKGKSLLFKTENGVNMCTLMAMDLGELCEDTITYNCPLLRQNEPEDIDCWCNSTSTWVTYGTCTATGEHRREKRSVALVPHVGMGLETRTETWMSSEGAWKHAQRIETWILRHPGFTIMAAILAYTIGTTYFQRVLIFILLTAVTPSMAMRCIGISNRDFVEGVSGGSWVDIVLEHGSCVTTMAKNKPTLDFELIKTEAKHLATLRKYCVEAKLTNTTTASRCPTQGEPSLNEEQDKRFVCKHSMVDRGWGNGCGLFGKGGIVTCAMFTCKKNMEGKVVQPENLEYTIVITPHSGEENAVGNDTGKHGKEIKVTPQSSITEAELTGYGTVTMECSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRHVLGRLITVNPIVTEKDSPVNIEAEPPFGDSYIIIGVEPGQLKLSWFKKGSSIGQMFETTMRGAKRMAILGDTAWDFGSLGGVFTSIGKALHQVFGAIYGAAFSGVSWTMKILIGVVITWIGMNSRSTSLSVSLVLVGVVTLYLGVMVQADSGCVVSWKNKELKCGSGIFITDNVHTWTEQYKFQPESPSKLASAIQKAHEEGICGIRSVTRLENLMWKQITPELNHILTENEVKLTIMTGDIKGIMQAGKRTLRPQPTELKYSWKAWGKAKMLSTELHNHTFLIDGPETAECPNTNRAWNSLEVEDYGFGVFTTNIWLKLKERQDVFCDSKLMSAAIKDNRAVHADMGYWIESALNDTWKIEKASFIEVKSCHWPKSHTLWSNGVLESEMIIPKNFAGPVSQHNYRPGYHTQTAGPWHLGRLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKIRPTFAAGLLLRKLTSKELMMTTIGIVLLSQSTIPESILELTDALALGMMVLKIVRNMEKYQLAVTIMAILCVPNAVILQNAWKVSCTTLAVVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVRWEEQAEISGSSPILSITISEDGSMSIKNEEEEQTLTILIRTGLLVISGLFPVSIPITAAAWYLWEVKKQRAGVLWDVPSPPPVGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIVDKKGKVVGLYGNGVVTRSGTYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPIRVPNYNLIIMDEAHFTDPASIAARGYISTRVEMGEAAGIFMTATPPGSRDPFPQSNAPIMDEEKEIPERSWNSGHEWVTDFKGKTVWFVPSIKAGNDIAACLRKNGKKVIQLSRKTFDSEYIKTRTNDWDFVVTTDISEMGANFKAERVIDPRRCMKPVILTDGEERVILAGPMPVTHSSAAQRRGRVGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGVKNNQILEENVEVEIWTKEGERKKLKPRWLDARIYSDPLALKEFKEFAAGRKSLTLNLITEMGRLPTFMTQKAKNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDFGLGSITTQQPESNILDIDLRPASAWTLYAVATTFITPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGMTVIDLDPIPYDPKFEKQLGQVMLLVLCVTQVLMMRTTWALCEALTLATGPISTLWEGNPGRFWNTTIAVSMANIFRGSYLAGAGLLFSIMKNTANTRRGTGNTGETLGEKWKNRLNALGKSEFQIYKKSGIQEVDRTLAKEGIKRGETDHHAVSRGSAKLRWFVERNLVTPEGKVVDLGCGRGGWSYYCGGLKNVKEVKGLTKGGPGHEEPIPMSTYGWNLVRLQSGVDVFFTPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESETPNLDIIGKRIEKIKQEHETSWHYDQDHPYKTWAYHGSYETKQTGSASSMVNGVVRLLTKPWDVIPMVTQMAMTDTTPFGQQRVFKEKVDTRTQEPKEGTKKLMKITAEWLWKELGKKKTPRMCTREEFTRKVRSNAALGAIFTDENKWKSAREAVEDSGFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVVTYGLNTFTNMEAQLIRQMEGEGVFKSIQQLTVKEEIAVKNWLIRVGRERLSRMAISGDDCVVKPLDDRFASALTALNDMGKVRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWIPTSRTTWSIHATHEWMTTEDMLTVWNRVWIQENPWMEDKTPVESWEEIPYLGKREDQWCGSLIGLTSRATWAKNIQTAINQVRSLIGNEEYTDYMPSMKRFRREEEEAGVLW

SEQ ID NO: 3814 - protein, 3291 aa, Artificial Sequence
  derived and/or modified protein sequence (wt) from DENV-2__KM279544__SS-prME
TAGIIIMMIPTVMAFHLTTRNGEPHMIVSRQEKGKSLLFKTENGVNMCTLMAMDLGELCEDTITYNCPLLRQNEPEDIDCWCNSTSTWVTYGTCTATGEHRREKRSVALVPHVGMGLETRTETWMSSEGAWKHAQRIETWILRHPGFTIMAAILAYTIGTTYFQRVLIFILLTAVTPSMAMRCIGTSNRDFVEGVSGGSWVDIVLEHGSCVTTMAKNKPTLDFELIKTEAKHLATLRKYCVEAKLTNTTTASRCPTQGEPSLNEEQDKRFVCKHSMVDRGWGNGCGLFGKGGIVTCAMFTCKKNMEGKVVQPENLEYTIVITPHSGEENAVGNDTGKHGKEIKVTPQSSITEAELTGYGTVTMECSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRHVLGRLITVNPIVTEKDSPVNIEAEPPFGDSYIIIGVEPGQLKLSWFKKGSSIGQMFETTMRGAKRMAILGDTAWDFGSLGGMFTSIGKALHQVFGAIYGAAFSGVSWTMKILIGVVITWIGMNSRSTSLSVSLVLVGVVTLYLGVMVQADSGCVVSWKNKELKCGSGIFITDNVHTWTEQYKFQPESPSKLASAIQKAHEEGICGIRSVTRLENLMWKQITPELNHILTENEVKLTIMTGDIKGIMQAGKRSLRPQPTELKYSWKAWGKAKMLSTELHNHTFLIDGPETAECPNTNRAWNSLEVEDYGFGVFTTNIWLKLKERQDVFCDSKLMSAAIKDNRAVHADMGYWIESALNDTWKIEKASFIEVKSCHWPKSHTLWSNGVLESEMIIPKNFAGPVSQHNYRPGYHTQTAGPWHLGRLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMTTIGIVLLSQSTIPESILELTDALALGMMVLKIVRNMEKYQLAVTIMAILCVPNAVILQNAWKVSCTTLAVVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVRWEEQAEISGSSPILSITISEDGSMSIKNEEEEQTLTILIRTGLLVISGLFPVSIPITAAAWYLWEVKKQRAGVLWDVPSPPPVGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIVDKKGKVVGLYGNGVVTRSGTYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPIRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYIKTRTNDWDFVVTTDISEMGANFKAERVIDPRRCMKPVILTDGEERVILAGPMPVTHSSAAQRRGRVGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGVKNNQILEENVEVEIWTKEGERKKLKPRWLDARIYSDPLALKEFKEFAAGRKSLTLNLITEMGRLPTFMTQKAKNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDFGLGSITTQQPESNILDIDLRPASAWTLYAVATTFITPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGMTVIDLDPIPYDPKFEKQLGQVMLLVLCVTQVLMMRTTWALCEALTLATGPISTLWEGNPGRFWNTTIAVSMANIFRGSYLAGAGLLFSIMKNTANTRRGTGNTGETLGEKWKNRLNALGKSEFQIYKKSGIQEVDRTLAKEGIKRGETDHHAVSRGSAKLRWFVERNLVTPEGKVVDLGCGRGGWSYYCGGLKNVKEVKGLTKGGPGHEEPIPMSTYGWNLVRLQSGVDVFFTPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESETPNLDIIGKRIEKIKQEHETSWHYDQDHPYKTWAYHGSYETKQTGSASSMVNGVVRLLTKPWDVIPMVTQMAMTDTTPFGQQRVFKEKVDTRTQEPKEGTKKLMKITAEWLWKELGKKKTPRMCTREEFTRKVRSNAALGAIFTDENKWKSAREAVEDSGFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVVTYGLNTFTNMEAQLIRQMEGEGVFKSIQQLTVKEEIAVKNWLIRVGRERLSRMAISGDDCVVKPLDDRFASALTALNDMGKVRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWIPTSRTTWSIHATHEWMTTEDMLTVWNRVWIQENPWMEDKTLVESWEEIPYLGKREDQWCGSLIGLTSRATWAKNIQTAINQVRSLIGNEEYTDYMPSMKRFRREEEEAGVLW

SEQ ID NO: 3815 - protein, 3291 aa, Artificial Sequence
  derived and/or modified protein sequence (wt) from DENV-2__KM279549__SS-prME
TAGIIIMMIPTVMAFHLTTRNGEPHMIVSRQEKGKSLLFKTENGVNMCTLMAMDLGELCEDTITYNCPLLRQNEPEDIDCWCNSTSTWVTYGTCTATGEHRREKRSVALVPHVGMGLETRTETWMSSEGAWKHAQRIETWILRHPGFTIMAAILAYTIGTTYFQRVLIFILLTAVTPSMAMRCIGISNRDFVEGVSGGSWVDIVLEHGSCVTTMAKNKPTLDFELIKTEAKHLATLRKYCVEAKLTNTTTASRCPTQGEPSLNEEQDKRFVCKHSMVDRGWGNGCGLFGKGGIVTCAMFTCKKNMEGKVVQPENLEYTIVITPHSGEENAVGNDTGKHGKEIKVTPQSSITEAELTGYGTVTMECSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRHVLGRLITVNPIVTEKDSPVNIEAEPPFGDSYIIIGVEPGQLKLSWFKKGSSIGQMFETTMRGAKRMAILGDTAWDFGSLGGVFTSIGKALHQVFGAIYGAAFSGVSWTMKILIGVVITWIGMNSRSTSLSVSLVLVGVVTLYLGVMVQADSGCVVSWKNKELKCGSGIFITDNVHTWTEQYKFQPESPSKLASAIQKAHEEGICGIRSVTRLENLMWKQITPELNHILTENEVKLTIMTGDIKGIMQAGKRSLRPQPTELKYSWKAWGKAKMLSTELHNHTFLIDGPETAECPNTNRAWNSLEVEDYGFGVFTTNIWLKLKERQDVFCDSKLMSAAIKDNRAVHADMGYWIESALNDTWKIEKASFIEVKSCHWPKSHTLWSNGVLESEMIIPKNFAGPVSQHNYRPGYHTQTAGPWHLGRLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMTTIGIVLLSQSTIPESILELTDALALGMMVLKIVRNMEKYQLAVTIMAILCVPNAVILQNAWKVSCTTLAVVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVRWEEQAEISGSSPILSITISEDGSMSIKNEEEEQTLTILIRTGLLVISGLFPVSIPITAAAWYLWEVKKQRAGVLWDVPSPPPVGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIVDKKGKVVGLYGNGVVTRSGTYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPIRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYIKTRTNDWDFVVTTDISEMGANFKAERVIDPRRCMKPVILTDGEERVILAGPMPVTHSSAAQRRGRVGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYVDRRWCFDGVKNNQILEENVEVEIWTKEGERKKLKPRWLDARIYSDPLALKEFKEFAAGRKSLTLNLITEMGRLPTFMTQKAKNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDFGLGSITTQQPESNILDIDLRPASAWTLYAVATTFITPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGMTVIDLDPIPYDPKFEKQLGQVMLLVLCVTQVLMMRTTWALCEALTLATGPISTLWEGNPGRFWNTTIAVSMANIFRGSYLAGAGLLFSIMKNTANTRRGTGNTGETLGEKWKNRLNALGKSEFQIYKKSGIQEVDRTLAKEGIKRGETDHHAVSRGSAKLRWFVERNLVTPEGKVVDLGCGRGGWSYYCGGLKNVKEVKGLTKGGPGHEEPIPMSTYGWNLVRLQSGVDVFFTPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESETPNLDIIGKRIEKIKQEHETSWHYDQDHPYKTWAYHGSYETKQTGSASSMVNGVVRLLTKPWDVIPMVTQMAMTDTTPFGQQRVFKEKVDTRTQEPKEGTKKLMKITAEWLWKELGKKKTPRMCTREEFTRKVRSNAALGAIFTDENKWKSAREAVEDSGFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVVTYGLNTFTNMEAQLIRQMEGEGVFKSIQQLTVKEEIAVKNWLIRVGRERLSRMAISGDDCVVKPLDDRFASALTALNDMGKVRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWIPTSRTTWSIHATHEWMTTEDMLTVWNRVWIQENPWMEDKTPVESWEEIPYLGKREDQWCGSLIGLTSRATWAKNIQTAINQVRSLIGNEEYTDYMPSMKRFRREEEEAGVLW

SEQ ID NO: 3816 - protein, 3291 aa, Artificial Sequence
  derived and/or modified protein sequence (wt) from DENV-2__KM279552__SS-prME
TAGIIIMMIPTVMAFHLTTRNGEPHMIVSRQEKGKSLLFKTENGVNMCTLMAMDLGELCEDTITYNCPLLRQNEPEDIDCWCNSTSTWVTYGTCTATGEHRREKRSVALVPHVGMGLETRTETWMSSEGAWKHAQRIETWILRHPGFTIMAAILAYTIGTTYFQRVLIFILLTAVTPSMAMRCIGISNRDFVEGVSGGSWVDIVLEHGSCVTTMAKNKPTLDFELIKTEAKHLATLRKYCVEAKLTNTTTASRCPTQGEPSLNEEQDKRFVCKHSMVDRGWGNGCGLFGKGGIVTCAMFTCKKNMEGKVVQPENLEYTIVITPHSGEENAVGNDTGKHGKEIKVTPQSSITEAELTGYGTVTMECSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRHVLGRLITVNPIVTEKDSPVNIEAEPPFGDSYIIIGVEPGQLKLSWFKKGSSIGQMFETTMRGAKRMAILGDTAWDFGSLGGVFTSIGKALHQVFGAIYGAAFSGVSWTMKILIGVVITWIGMNSRSTSLSVSLVLVGVVTLYLGVMVQADSGCVVSWKNKELKCGSGIFITDNVHTWTEQYKFQPESPSKLASAIQKAHEEGICGIRSVTRLENLMWKQITPELNHILTENEVKLTIMTGDIKGIMQAGKRSLRPQPTELKYSWKAWGKAKMLSTELHNHTFLIDGPETAECPNTNRAWNSLEVEDYGFGVFTTNIWLKLKERQDVFCDSKLMSAAIKDNRAVHADMGYWIESALNDTWKIEKASFIEVKSCHWPKSHTLWSNGVLESEMIIPKNFAGPVSQHNYRPGYHTQTAGPWHLGRLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMTTIGIVLLSHSTIPESILELTDALALGMMVLKIVRNMEKYQLAVTIMAILCVPNAVILQNAWKVSCTTLAVVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVRWEEQAEISGSSPILSITISEDGSMSIKNEEEEQTLTILIRTGLLVISGLFPVSIPITAAAWYLWEVKKQRAGVLWDVPSPPPVGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIVDKKGKVVGLYGNGVVTRSGTYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPIRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYIKTRTNDWDFVVTTDISEMGANFKAERVIDPRRCMKPVILTDGEERVILAGPMPVTHSSAAQRRGRVGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGVKNNQILEENVEVEIWTKEGERKKLKPRWLDARIYSDPLALKEFKEFAAGRKSLTLNLITEMGRLPTFMTQKAKNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDFGLGSITTQQPESNILDIDLRPASAWTLYAVATTFITPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGMTVIDLDPIPYDPKFEKQLGQVMLLVLCVTQVLMMRTTWALCEALTLATGPISTLWEGNPGRFWNTTIAVSMANIFRGSYLAGAGLLFSIMKNTANTRRGTGNTGETLGEKWKNRLNALGKSEFQIYKKSGIQEVDRTLAKEGIKRGETDHHAVSRGSAKLRWFVERNLVTPEGKVVDLGCGRGGWSYYCGGLKNVKEVKGLTKGGPGHEEPIPMSTYGWNLVRLQSGVDVFFTPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESETPNLDIIGKRIEKIKQEHETSWHYDQDHPYKTWAYHGSYETKQTGSASSMVNGVVRLLTKPWDVIPMVTQMAMTDTTPFGQQRVFKEKVDTRTQEPKEGTKKLMKITAEWLWKELGKKKTPRMCTREEFTRKVRSNAALGAIFTDENKWKSAREAVEDSGFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVVTYGLNTFTNMEAQLIRQMEGEGVFKSIQQLTVKEEIAVKNWLIRVGRERLSRMAISGDDCVVKPLDDRFASALTALNDMGKVRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWIPTSRTTWSIHATHEWMTTEDMLTVWNRVWIQENPWMEDKTPVESWEEIPYLGKREDQWCGSLIGLTSRATWAKNIQTAINQVRSLIGNEEYTDYMPSMKRFRREEEEAGVLW

SEQ ID NO: 3817 - protein, 3291 aa, Artificial Sequence
  derived and/or modified protein sequence (wt) from DENV-2__KM279557__SS-prME
TAGIIIMMIPTVMAFHLTTRNGEPHMIVSRQEKGKSLLFKTENGVNMCTLMAMDLGELCEDTITYNCPLLRQNEPEDIDCWCNSTSTWVTYGTCTATGEHRREKRSVALVPHVGMGLETRTETWMSSEGAWKHAQRIETWILRHPGFTIMAAILAYTIGTTYFQRVLIFILLTAVTPSMAMRCIGISNRDFVEGVSGGSWVDIVLEHGSCVTTMAKNKPTLDFELIKTEAKHLATLRKYCVEAKLTNTTTASRCPTQGEPSLNEEQDKRFVCKHSMVDRGWGNGCGLFGKGGIVTCAMFTCKKNMEGKVVQPENLEYTIVITPHSGEENAVGNDTGKHGKEIKVTPQSSITEAELTGYGTVTMECSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRHVLGRLITVNPIVTEKDSPVNIEAEPPFGDSYIIIGVEPGQLKLSWFKKGSSIGQMFETTMRGAKRMAILGDTAWDFGSLGGVFTSIGKALHQVFGAIYGAAFSGVSWTMKILIGVVITWIGMNSRSTSLSVSLVLVGVVTLYLGVMVQADSGCVVSWKNKELKCGSGIFITDNVHTWTEQYKFQPESPSKLASAIQKAHEEGICGIRSVTRLENLMWKQITPELNHILTENEVKLTIMTGDIKGIMQAGKRSLRPQPTELKYSWKAWGKAKMLSTELHNHTFLIDGPETAECPNTNRAWNSLEVEDYGFGVFTTNIWLKLKERQDVFCDSKLMSAAIKDNRAVHADMGYWIESALNDTWKIEKASFIEVKSCHWPKSHTLWSNGVLESEMIIPKNFAGPVSQHNYRPGYHTQTAGPWHLGRLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMTTIGIVLLSQSTIPESILELTDALALGMMVLKIVRNMEKYQLAVTIMAILCVPNAVILQNAWKVSCTTLAVVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVRWEEQAEISGSSPILSITISEDGSMSIKNEEEEQTLTILIRTGLLVISGLFPVSIPITAAAWYLWEVKKQRAGVLWDVPSPPPVGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIVDKKGKVVGLYGNGVVTRSGTYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPIRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYIKTRTNDWDFVVTTDISEMGANFKAERVIDPRRCMKPVILTDGEERVILAGPMPVTHSSAAQRRGRVGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGVKNNQILEENVEVEIWTKEGERKKLKPRWLDARIYSDPLALKEFKEFAAGRKSLTLNLITEMGRLPTFMTQKAKNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDFGLGSITTQQPESNILDIDLRPASAWTLYAVATTFITPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGMTVIDLDPIPYDPKFEKQLGQVMLLVLCVTQVLMMRTTWALCEALTLATGPISTLWEGNPGRFWNTTIAVSMANIFRGSYLAGAGLLFSIMKNTANTRRGTGNTGETLGEKWKNRLNALGKSEFQIYKKSGIQEVDRTLAKEGIKRGETDHHAVSRGSAKLRWFVERNLVTPEGKVVDLGCGRGGWSYYCGGLKNVKEVKGLTKGGPGHEEPIPMSTYGWNLVRLQSGVDVFFTPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESETPNLDIIGKRIEKIKQEHETSWHYDQDHPYKTWAYHGSYETKQTGSASSMVNGVVRLLTKPWDVIPMVTQMAMTDTTPFGQQRVFKEKVDTRTQEPKEGTKKLMKITAEWLWKELGKKKTPRMCTREEFTRKVRSNAALGAIFTDENKWKSAREAVEDSGFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVVTYGLNTFTNMEAQLIRQMEGEGVFKSIQQLTVKEEIAVKNWLIRVGRERLSRMAISGDDCVVKPLDDRFASALTALNDMGKVRKDIQQWEPSRGWNDWTQVPFCSHHFHELIMKDGRVLVVPCRNQDELIGRARISQGAGWSLRETACLGKSYAQMWSLMYFHRRDLRLAANSICSAVPSHWIPTSRTTWSIHATHEWMTTEDMLTVWNRVWIQENPWMEDKTPVESWEEIPYLGKREDQWCGSLIGLTSRATWAKNIQTAINQVRSLIGNEEYTDYMPSMKRFRREEEEAGVLW

SEQ ID NO: 3818 - protein, 3291 aa, Artificial Sequence
  derived and/or modified protein sequence (wt) from DENV-2__KM279591__SS-prME
TAGIIIMMIPTVMAFHLTTRNGEPHMIVSRQEKGKSLLFKTENGVNMCTLMAMDLGELCEDTITYNCPLLRQNEPEDIDCWCNSTSTWVTYGTCTATGEHRREKRSVALVPHVGMGLETRTETWMSSEGAWKHAQRIETWILRHPGFTIMAAILAYTIGTTYFQRVLIFILLTAVTPSMAMRCIGISNRDFVEGVSGGSWVDIVLEHGSCVTTMAKNKPTLDFELIKTEAKHLATLRKYCVEAKLTNTTTASRCPTQGEPSLNEEQDKRFVCKHSMVDRGWGNGCGLFGKGGIVTCAMFTCKKNMEGKVVQPENLEYTIVITPHSGEENAVGNDTGKHGKEIKVTPQSSITEAELTGYGTVTMECSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRHVLGRLITVNPIVTEKDSPVNIEAEPPFGDSYIIIGVEPGQLKLSWFKKGSSIGQMFETTMRGAKRMAILGDTAWDFGSLGGVFTSIGKALHQVFGAIYGAAFSGVSWTMKILIGVVITWIGMNSRSTSLSVSLVLVGVVTLYLGVMVQADSGCVVSWKNKELKCGSGIFITDNVHTWTEQYKFQPESPSKLASAIQKAHEEGICGIRSVTRLENLMWKQITPELNHILTENEVKLTIMTGDIKGIMQAGKRTLRPQPTELKYSWKAWGKAKMLSTELHNHTFLIDGPETAECPNTNRAWNSLEVEDYGFGVFTTNIWLKLKERQDVFCDSKLMSAAIKDNRAVHADMGYWIESALNDTWKIEKASFIEVKSCHWPKSHTLWSNGVLESEMIIPKNFAGPVSQHNYRPGYHTQTAGPWHLGRLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMTTIGIVLLSQSTIPESILELTDALALGMMVLKIVRNMEKYQLAVTIMAILCVPNAVILQNAWKVSCTTLAVVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVRWEEQAEISGSSPILSITISEDGSMSIKNEEEEQTLTILIRTGLLVISGLFPVSIPITAAAWYLWEVKKQRAGVLWDVPSPPPVGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIVDKKGKVVGLYGNGVVTRSGTYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPIRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYIKTRTNDWDFVVTTDISEMGANFKAERVIDPRRCMKPVILTDGEERVILAGPMPVTHSSAAQRRGRVGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYVDRRWCFDGVKNNQILEENVEVEIWTKEGERKKLKPRWLDARIYSDPLALKEFKEFAAGRKSLTLNLITEMGRLPTFMTQKAKNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDFGLGSITTQQPESNILDIDLRPASAWTLYAVATTFITPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGMTVIDLDPIPYDPKFEKQLGQVMLLVLCVTQVLMMRTTWALCEALTLATGPISTLWEGNPGRFWNTTIAVSMANIFRGSYLAGAGLLFSIMKNTANTRRGTGNTGETLGEKWKNRLNALGKSEFQIYKKSGIQEVDRTLAKEGIKRGETDHHAVSRGSAKLRWFVERNLVTPEGKVVDLGCGRGGWSYYCGGLKNVKEVKGLTKGGPGHEEPIPMSTYGWNLVRLQSGVDVFFTPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESETPNLDIIGKRIEKIKQEHETSWHYDQDHPYKTWAYHGSYETKQTGSASSMVNGVVRLLTKPWDVIPMVTQMAMTDTTPFGQQRVFKEKVDTRTQEPKEGTKKLMKITAEWLWKELGKKKTPRMCTREEFTRKVRSNAALGAIFTDENKWKSAREAVEDSGFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVVTYGLNTFTNMEAQLIRQMEGEGVFKSIQQLTVKEEIAVKNWLIRVGRERLSRMAISGDDCVVKPLDDRFASALTALNDMGKVRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWIPTSRTTWSIHATHEWMTTEDMLTVWNRVWIQENPWMEDKTPVESWEEIPYLGKREDQWCGSLIGLTSRATWAKNIQTAINQVRSLIGNEEYTDYMPSMKRFRREEEEAGVLW

SEQ ID NO: 3819 - protein, 3291 aa, Artificial Sequence
  derived and/or modified protein sequence (wt) from DENV-2__KM279558__SS-prME
TAGIIIMMIPTVMAFHLTTRNGEPHMIVSRQEKGKSLLFKTENGVNMCTLMAMDLGELCEDTITYNCPLLRQNEPEDIDCWCNSTSTWVTYGTCTATGEHRREKRSVALVPHVGMGLETRTETWMSSEGAWKHAQRIETWILRHPGFTIMAAILAYTIGTTYFQRVLIFILLTAVTPSMAMRCIGISNRDFVEGVSGGSWVDIVLEHGSCVTTMAKNKPTLDFELIKTEAKHLATLRKYCVEAKLTNTTTASRCPTQGEPSLNEEQDKRFVCKHSMVDRGWGNGCGLFGKGGIVTCAMFTCKKNMEGKVVQPENLEYTIVITPHSGEENAVGNDTGKHGKEIKITPQSSITEAELTGYGTVTMECSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRHVLGRLITVNPIVTEKDSPVNIEAEPPFGDSYIIIGVEPGQLKLSWFKKGSSIGQMFETTMRGAKRMAILGDTAWDFGSLGGVFTSIGKALHQVFGAIYGAAFSGVSWTMKILIGVVITWIGMNSRSTSLSVSLVLVGVVTLYLGVMVQADSGCVVSWKNKELKCGSGIFITDNVHTWTEQYKFQPESPSKLASAIQKAHEEGICGIRSVTRLENLMWKQITPELNHILTENEVKLTIMTGDIKGIMQAGKRSLRPQPTELKYSWKAWGKAKMLSTELHNHTFLIDGPETAECPNTNRAWNSLEVEDYGFGVFTTNIWLKLKERQDVFCDSKLMSAAIKDNRAVHADMGYWIESALNDTWKIEKASFIEVKSCHWPKSHTLWSNGVLESEMIIPKNFAGPVSQHNYRPGYHTQTAGPWHLGRLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMTTIGIVLLSQSTIPESILELTDALALGMMVLKIVRNMEKYQLAVTIMAISCVPNAVILQNAWKVSCTTLAVVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVRWEEQAEISGSSPILSITISEDGSMSIKNEEEEQTLTILIRTGLLVISGLFPVSIPITAAAWYLWEVKKQRAGVLWDVPSPPPVGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIVDKKGKVVGLYGNGVVTRSGTYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPIRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYIKTRTNDWDFVVTTDISEMGANFKAERVIDPRRCMKPVILTDGEERVILAGPMPVTHSSAAQRRGRVGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGVKNNQILEENVEVEIWTKEGERKKLKPRWLDARIYSDPLALKEFKEFAAGRKSLTLNLITEMGRLPTFMTQKAKNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDFGLGSITTQQPESNILDIDLRPASAWTLYAVATTFITPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGMTVIDLDPIPYDPKFEKQLGQVMLLVLCVTQVLMMRTTWALCEALTLATGPISTLWEGNPGRFWNTTIAVSMANIFRGSYLAGAGLLFSIMKNTANTRRGTGNTGETLGEKWKNRLNALGKSEFQIYKKSGIQEVDRTLAKEGIKRGETDHHAVSRGSAKLRWFVERNLVTPEGKVVDLGCGRGGWSYYCGGLKNVKEVKGLTKGGPGHEEPIPMSTYGWNLVRLQSGVDVFFTPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESETPNLDIIGKRIEKIKQEHETSWHYDQDHPYKTWAYHGSYETKQTGSASSMVNGVVRLLTKPWDVIPMVTQMAMTDTTPFGQQRVFKEKVDTRTQEPKEGTKKLMKITAEWLWKELGKKKTPRMCTREEFTRKVRSNAALGAIFTDENKWKSAREAVEDSGFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVVTYGLNTFTNMEAQLIRQMEGEGVFKSIQQLTVKEEIAVKNWLIRVGRERLSRMAISGDDCVVKPLDDRFASALTALNDMGKVRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWIPTSRTTWSIHATHEWMTTEDMLTVWNRVWIQENPWMEDKTPVESWEEIPYLGKREDQWCGSLIGLTSRATWAKNIQTAINQVRSLIGNEEYTDYMPSMKRFRREEEEAGVLW

SEQ ID NO: 3820 - protein, 3291 aa, Artificial Sequence
  derived and/or modified protein sequence (wt) from DENV-2__KM279564__SS-prME
TAGIIIMMIPTVMAFHLTTRNGEPHMIVSRQEKGKSLLFKTENGVNMCTLMAMDLGELCEDTITYNCPLLRQNEPEDIDCWCNSTSTWVTYGTCTATGEHRREKRSVALVPHVGMGLETRTETWMSSEGAWKHAQRIETWILRHPGFTIMAAILAYTIGTTYFQRVLIFILLTAVTPSMAMRCIGISNRDFVEGVSGGSWVDIVLEHGSCVTTMAKNKPTLDFELIKTEAKHLATLRKYCVEAKLTNTTTASRCPTQGEPSLNEEQDKRFVCKHSMVDRGWGNGCGLFGKGGIVTCAMFTCKKNMEGKVVQPENLEYTIVITPHSGEENAVGNDTGKHGKEIKITPQSSITEAELTGYGTVTMECSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRHVLGRLITVNPIVTEKDSPVNIEAEPPFGDSYIIIGVEPGQLKLSWFKKGSSIGQMFETTMRGAKRMAILGDTAWDFGSLGGVFTSIGKALHQVFGAIYGAAFSGVSWTMKILIGVVITWIGMNSRSTSLSVSLVLVGVVTLYLGVMVQADSGCVVSWKNKELKCGSGIFITDNVHTWTEQYKFQPESPSKLASAIQKAHEEGICGIRSVTRLENLMWKQITPELNHILTENEVKLTIMTGDIKGIMQAGKRSLRPQPTELKYSWKAWGKAKMLSTELHNHTFLIDGPETAECPNTNRAWNSLEVEDYGFGVFTTNIWLKLKERQDVFCDSKLMSAAIKDNRAVHADMGYWIESALNDTWKIEKASFIEVKSCHWPKSHTLWSNGVLESEMIIPKNFAGPVSQHNYRPGYHTQTAGPWHLGRLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMTTIGIVLLSQSTIPESILELTDALALGMMVLKIVRNMEKYQLAVTIMAISCVPNAVILQNAWKVSCTTLAVVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVRWEEQAEISGSSPILSITISEDGSMSIKNEEEEQTLTILIRTGLLVISGLFPVSIPITAAAWYLWEVKKQRAGVLWDVPSPPPVGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIVDKKGKVVGLYGNGVVTRSGTYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPIRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYIKTRTNDWDFVVTTDISEMGANFKAERVIDPRRCMKPVILTDGEERVILAGPMPVTHSSAAQRRGRVGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGVKNNQILEENVEVEIWTKEGERKKLKPRWLDARIYSDPLALKEFKEFAAGRKSLTLNLITEMGRLPTFMTQKAKNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDFGLGSITTQQPESNILDIDLRPASAWTLYAVATTFITPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGMTVIDLDPIPYDPKFEKQLGQVMLLVLCVTQVLMMRTTWALCEALTLATGPISTLWEGNPGRFWNTTIAVSMANIFRGSYLAGAGLLFSIMKNTANTRRGTGNTGETLGEKWKNRLNALGKSEFQIYKKSGIQEVDRTLAKEGIKRGETDHHAVSRGSAKLRWFVERNLVTPEGKVVDLGCGRGGWSYYCGGLKNVKEVKGLTKGGPGHEEPIPMSTYGWNLVRLQSGVDVFFTPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESETPNLDIIGKRIEKIKQEHETSWHYDQDHPYKTWAYHGSYETKQTGSASSMVNGVVRLLTKPWDVIPMVTQMAMTDTTPFGQQRVFKEKVDTRTQEPKEGTKKLMKITAEWLWKELGKKKTPRMCTREEFTRKVRSNAALGAIFTDENKWKSAREAVEDSGFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVVTYGLNTFTNMEAQLIRQMEGEGVFKSIQQLTVKEEIAVKNWLIRVGRERLSRMAISGDDCVVKPLDDRFASALTALNDMGKVRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWIPTSRTTWSIHATHEWMTTEDMLTVWNRVWIQENPWMEDKTPVESWEEIPYLGKREDQWCGSLIGLTSRATWAKNIQTAINQVRSLIGNEEYTDYMPSMKRFRIEEEEAGVLW

SEQ ID NO: 3821 - protein, 3291 aa, Artificial Sequence
  derived and/or modified protein sequence (wt) from DENV-2__KM279595__SS-prME
TAGIIIMMIPTVMAFHLTTRNGEPHMIVSRQEKGKSLLFKTENGVNMCTLMAMDLGELCEDTITYNCPLLRQNEPEDIDCWCNSTSTWVTYGTCTATGEHRREKRSVALVPHVGMGLETRTETWMSSEGAWKHAQRIETWILRHPGFTIMAAILAYTIGTTYFQRVLIFILLTAVTPSMAMRCIGISNRDFVEGVSGGSWVDIVLEHGSCVTTMAKNKPTLDFELIKTEAKHLATLRKYCVEAKLTNTTTASRCPTQGEPSLNEEQDKRFVCKHSMVDRGWGNGCGLFGKGGIVTCAMFTCKKNMEGKVVQPENLEYTIVITPHSGEENAVGNDTGKHGKEIKVTPQSSITEAELTGYGTVTMECSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRHVLGRLITVNPIVTEKDSPVNIEAEPPFGDSYIIIGVEPGQLKLSWFKKGSSIGQMFETTMRGAKRMAILGDTAWDFGSLGGVFTSIGKALHQVFGAIYGAAFSGVSWTMKILIGVVITWIGMNSRSTSLSVSLVLVGVVTLYLGVMVQADSGCVVSWKNKELKCGSGIFITDNVHTWTEQYKFQPESPSKLASAIQKAHEEGICGIRSVTRLENLMWKQITPELNHILTENEVKLTIMTGDIKGIMQAGKRTLRPQPTELKYSWKAWGKAKMLSTELHNHTFLIDGPETAECPNTNRAWNSLEVEDYGFGVFTTNIWLKLKERQDVFCDSKLMSAAIKDNRAVHADMGYWIESALNDTWKIEKASFIEVKSCHWPKSHTLWSNGVLESEMIIPKNFAGPVSQHNYRPGYHTQTAGPWHLGRLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMTTIGIVLLSQSTIPESILELTDALALGMMVLKIVRNMEKYQLAVTIMAILCVPNAVILQNAWKVSCTTLAVVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVRWEEQAEISGSSPILSITISEDGSMSIKNEEEEQTLTILIRTGLLVISGLFPVSIPITAAAWYLWEVKKQRAGVLWDVPSPPPVGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIVDKKGKVVGLYGNGVVTRSGTYVSAIAQTEKNIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPIRVPNYNLIIMDEAHFTDPASIAARGYISTRVEMGEAAGIFMTATPPGSRDPFPQSNAPIMDEEKEIPERSWNSGHEWVTDFKGKTVWFVPSIKAGNDIAACLRKNGKKVIQLSRKTFDSEYIKTRTNDWDFVVTTDISEMGANFKAERVIDPRRCMKPVILTDGEERVILAGPMPVTHSSAAQRRGRVGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGVKNNQILEENVEVEIWTKEGERKKLKPRWLDARIYSDPLALKEFKEFAAGRKSLTLNLITEMGRLPTFMTQKAKNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDFGLGSITTQQPESNILDIDLRPASAWTLYAVATTFITPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGMTVIDLDPIPYDPKFEKQLGQVMLLVLCVTQVLMMRTTWALCEALTLATGPISTLWEGNPGRFWNTTIAVSMANIFRGSYLAGAGLLFSIMKNTANTRRGTGNTGETLGEKWKNRLNALGKSEFQIYKKSGIQEVDRTLAKEGIKRGETDHHAVSRGSAKLRWFVERNLVTPEGKVVDLGCGRGGWSYYCGGLKNVKEVKGLTKGGPGHEEPIPMSTYGWNLVRLQSGVDVFFTPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESETPNLDIIGKRIEKIKQEHETSWHYDQDHPYKTWAYHGSYETKQTGSASSMVNGVVRLLTKPWDVIPMVTQMAMTDTTPFGQQRVFKEKVDTRTQEPKEGTKKLMKITAEWLWKELGKKKTPRMCTREEFTRKVRSNAALGAIFTDENKWKSAREAVEDSGFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVVTYGLNTFTNMEAQLIRQMEGEGVFKSIQQLTVKEEIAVKDWLIRVGRERLSRMAISGDDCVVKPLDDRFASALTALNDMGKVRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWIPTSRTTWSIHATHEWMTTEDMLTVWNRVWIQENPWMEDKTPVESWEEIPYLGKREDQWCGSLIGLTSRATWAKNIQTAINQVRSLIGNEEYTDYMPSMKRFRREEEEAGVLW

SEQ ID NO: 3822 - protein, 3291 aa, Artificial Sequence
  derived and/or modified protein sequence (wt) from DENV-2__KM279566__SS-prME
TAGIIIMMIPTVMAFHLTTRNGEPHMIVSRQEKGKSLLFKTENGVNMCTLMAMDLGELCEDTITYNCPLLRQNEPEDIDCWCNSTSTWVTYGTCTATGEHRREKRSVALVPHVGMGLETRTETWMSSEGAWKHAQRIETWILRHPGFTIMAAILAYTIGTTYFQRVLIFILLTAVTPSMAMRCIGISNRDFVEGVSGGSWVDIVLEHGSCVTTMAKNKPTLDFELIKTEAKHLATLRKYCVEAKLTNTTTASRCPTQGEPSLNEEQDKRFVCKHSMVDRGWGNGCGLFGKGGIVTCAMFTCKKNMEGKVVQPENLEYTIVITPHSGEENAVGNDTGKHGKEIKVTPQSSITEAELTGYGTVTMECSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRHVLGRLITVNPIVTEKDSPVNIEAEPPFGDSYIIIGVEPGQLKLSWFKKGSSIGQMFETTMRGAKRMAILGDTAWDFGSLGGVFTSIGKALHQVFGAIYGAAFSGVSWTMKILIGVVITWIGMNSRSTSLSVSLVLVGVVTLYLGVMVQADSGCVVSWKNKELKCGSGIFITDNVHTWTEQYKFQPESPSKLASAIQKAHEEGICGIRSVTRLENLMWKQITPELNHILTENEVKLTIMTGDIKGIMQAGKRTLRPQPTELKYSWKAWGKAKMLSTELHNHTFLIDGPETAECPNTNRAWNSLEVEDYGFGVFTTNIWLKLKERQDVFCDSKLMSAAIKDNRAVHADMGYWIESALNDTWKIEKASFIEVKSCHWPKSHTLWSNGVLESEMIIPKNFAGPVSQHNYRPGYHTQTAGPWHLGRLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMTTIGIVLLSQSTIPESILELTDALALGMMVLKIVRNMEKYQLAVTIMAILCVPNAVILQNAWKVSCTTLAVVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVRWEEQAEISGSSPILSITISEDGSMSIKNEEEEQTLTILIRTGLLVISGLFPVSIPITAAAWYLWEVKKQRAGVLWDVPSPPPVGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIVDKKGKVVGLYGNGVVTRSGTYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPIRVPNYNLIIMDEAHFTDPASIAARGYISTRVEMGEAAGIFMTATPPGSRDPFPQSNAPIMDEEKEIPERSWNSGHEWVTDFKGKTVWFVPSIKAGNDIAACLRKNGKKVIQLSRKTFDSEYIKTRTNDWDFVVTTDISEMGANFKAERVIDPRRCMKPVILTDGEERVILAGPMPVTHSSAAQRRGRVGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGVKNNQILEENVEVEIWTKEGERKKLKPRWLDARIYSDPLALKEFKEFAAGRKSLTLNLITEMGRLPTFMTQKAKNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDFGLGSITTQQPESNILDIDLRPASAWTLYAVATTFITPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGMTVIDLDPIPYDPKFEKQLGQVMLLVLCVTQVLMMRTTWALCEALTLATGPISTLWEGNPGRFWNTTIAVSMANIFRGSYLAGAGLLFSIMKNTANTRRGTGNTGETLGEKWKNRLNALGKSEFQIYKKSGIQEVDRTLAKEGIKRGETDHHAVSRGSAKLRWFVERNLVTPEGKVVDLGCGRGGWSYYCGGLKNVKEVKGLTKGGPGHEEPIPMSTYGWNLVRLQSGVDVFFTPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESETPNLDIIGKRIEKIKQEHETSWHYDQDHPYKTWAYHGSYETKQTGSASSMVNGVVRLLTKPWDVIPMVTQMAMTDTTPFGQQRVFKEKVDTRTQEPKEGTKKLMKITAEWLWKELGKKKTPRMCTREEFTRKVRSNAALGAIFTDENKWKSAREAVEDSGFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVVTYGLNTFTNMEAQLIRQMEGEGVFKSIQQLTVKEEIAVKNWLIRVGRERLSRMAISGDDCVVKPLDDRFASALTALNDMGKVRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWIPTSRTTWSIHATHEWMTTEDMLTVWNRVWIQENPWMEDKTPVESWEEIPYLGKREDQWCGSLIGLTSRATWAKNIQTAINQVRSLIGNEEYTDYMPSMKRFRREEEEAGVLW

SEQ ID NO: 3823 - protein, 3291 aa, Artificial Sequence
  derived and/or modified protein sequence (wt) from DENV-2__KM279574__SS-prME
TAGIIIMMIPTVMAFHLTTRNGEPHMIVSRQEKGKSLLFKTENGVNMCTLMAMDLGELCEDTITYNCPLLRQNEPEDIDCWCNSTSTWVTYGTCTATGEHRREKRSVALVPHVGMGLETRTETWMSSEGAWKHAQRIETWILRHPGFTIMAAILAYTIGTTYFQRVLIFILLTAVTPSMAMRCIGISNRDFVEGVSGGSWVDIVLEHGSCVTTMAKNKPTLDFELIKTEAKHLATLRKYCVEAKLTNTTTASRCPTQGEPSLNEEQDKRFVCKHSMVDRGWGNGCGLFGKGGIVTCAMFTCKKNMEGKVVQPENLEYTIVITPHSGEENAVGNDTGKHGKEIKVTPQSSITEAELTGYGTVTMECSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRHVLGRLITVNPIVTEKDSPVNIEAEPPFGDSYIIIGVEPGQLKLSWFKKGSSIGQMFETTMRGAKRMAILGDTAWDFGSLGGVFTSIGKALHQVFGAIYGAAFSGVSWTMKILIGVVITWIGMNSRSTSLSVSLVLVGVVTLYLGVMVQADSGCVVSWKNKELKCGSGIFITDNVHTWTEQYKFQPESPSKLASAIQKAHEEGICGIRSVTRLENLMWKQITPELNHILTENEVKLTIMTGDIKGIMQAGKRTLRPQPTELKYSWKAWGKAKMLSTELHNHTFLIDGPETAECPNTNRAWNSLEVEDYGFGVFTTNIWLKLKERQDVFCDSKLMSAAIKDNRAVHADMGYWIESALNDTWKIEKASFIEVKSCHWPKSHTLWSNGVLESEMIIPKNFAGPVSQHNYRPGYHTQTAGPWHLGRLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKIRPTFAAGLLLRKLTSKELMMTTIGIVLLSQSTIPESILELTDALALGMMVLKIVRNMEKYQLAVTIMAILCVPNAVILQNAWKVSCTTLAVVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVRWEEQAEISGSSPILSITISEDGSMSIKNEEEEQTLTILIRTGLLVISGLFPVSIPITAAAWYLWEVKKQRAGVLWDVPSPPPVGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIVDKKGKVVGLYGNGVVTRSGTYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPIRVPNYNLIIMDEAHFTDPASIAARGYISTRVEMGEAAGIFMTATPPGSRDPFPQSNAPIMDEEKEIPERSWNSGHEWVTDFKGKTVWFVPSIKAGNDIAACLRKNGKKVIQLSRKTFDSEYIKTRTNDWDFVVTTDISEMGANFKAERVIDPRRCMKPVILTDGEERVILAGPMPVTHSSAAQRRGRVGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGVKNNQILEENVEVEIWTKEGERKKLKPRWLDARIYSDPLALKEFKEFAAGRKSLTLNLITEMGRLPTFMTQKAKNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDFGLGSITTQQPESNILDIDLRPASAWTLYAVATTFITPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGMTVIDLDPIPYDPKFEKQLGQVMLLVLCVTQVLMMRTTWALCEALTLATGPISTLWEGNPGRFWNTTIAVSMANIFRGSYLAGAGLLFSIMKNTANTRRGTGNTGETLGEKWKNRLNALGKSEFQIYKKSGIQEVDRTLAKEGIKRGETDHHAVSRGSAKLRWFVERNLVTPEGKVVDLGCGRGGWSYYCGGLKNVKEVKGLTKGGPGHEEPIPMSTYGWNLVRLQSGVDVFFTSPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESETPNLDIIGKRIEKIKQEHETSWHYDQDHPYKTWAYHGSYETKQTGSASSMVNGVVRLLTKPWDVIPMVTQMAMTDTTPFGQQRVFKEKVDTRTQEPKEGTKKLMKITAEWLWKELGKKKTPRMCTREEFTRKVRSNAALGAIFTDENKWKSAREAVEDSGFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLENEEMVTNHMEGEHKKLAEAIFKLTYQNKVVRVQRPTPRGTVMDIISRRDQRGSGQVVTYGLNTFTNMEAQLIRQMEGEGVFKSIQQLTVKEEIAVKNWLTRVGRERLSRMAISGDDCVVKPLDDRFASALTALNDMGKVRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWIPTSRTTWSIHATHEWMTTEDMLTVWNRVWIQENPWMEDKTPVESWEEIPYLGKREDQWCGSLIGLTSRATWAKNIQTAINQVRSLIGNEEYTDYMPSMKRFRREEEEAGVLW

SEQ ID NO: 3824 - protein, 3291 aa, Artificial Sequence
  derived and/or modified protein sequence (wt) from DENV-2__KM279568__SS-prME
TAGIIIMMIPTVMAFHLTTRNGEPHMIVSRQEKGKSLLFKTENGVNMCTLMAMDLGELCEDTITYNCPLLRQNEPEDIDCWCNSTSTWVTYGTCTATGEHRREKRSVALVPHVGMGLETRTETWMSSEGAWKHAQRIETWILRHPGFTIMAAILAYTIGTTYFQRVLIFILLTAVTPSMAMRCIGISNRDFVEGVSGGSWVDIVLEHGSCVTTMAKNKPTLDFELIKTEAKHLATLRKYCVEAKLTNTTTASRCPTQGEPSLNEEQDKRFVCKHSMVDRGWGNGCGLFGKGGIVTCAMFTCKKNMEGKVVQPENLEYTIVITPHSGEENAVGNDTGKHGKEIKITPQSSITEAELTGYGTVTMECSPRTGLDFNEMVLLQMENKAWLVHRQWFLDLPLPWLPGADTQGSNWIQKETLVTFKNPHAKKQDIVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRHVLGRLITVNPIVTEKDSPVNIEAEPPFGDSYIIIGVEPGQLKLSWFKKGSSIGQMFETTMRGAKRMAILGDTAWDFGSLGGVFTSIGKALHQVFGAIYGAAFSGVSWTMKILIGVVITWIGMNSRSTSLSVSLVLVGVVTLYLGVMVQADSGCVVSWKNKELKCGSGIFITDNVHTWTEQYKFQPESPSKLASAIQKAHEEGICGIRSVTRLENLMWKQITPELNHILTENEVKLTIMTGDIKGIMQAGKRSLRPQPTELKYSWKAWGKAKMLSTELHNHTFLIDGPETAECPNTNRAWNSLEVEDYGFGVFTTNIWLKLKERQDVFCDSKLMSAAIKDNRAVHADMGYWIESALNDTWKIEKASFIEVKSCHWPKSHTLWSNGVLESEMIIPKNFAGPVSQHNYRPGYHTQTAGPWHLGRLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMTTIGIVLLSQSTIPESILELTDALALGMMVLKIVRNMEKYQLAVTIMAISCVPNAVILQNAWKVSCTTLAVVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVRWEEQAEISGSSPILSITISEDGSMSIKNEEEEQTLTILIRTGLLVISGLFPVSIPITAAAWYLWEVKKQRAGVLWDVPSPPPVGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIVDKKGKVVGLYGNGVVTRSGTYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPIRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYIKTRTNDWDFVVTTDISEMGANFKAERVIDPRRCMKPVILTDGEERVILAGPMPVTHSSAAQRRGRVGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGVKNNQILEENVEVEIWTKEGERKKLKPRWLDARIYSDPLALKEFKEFAAGRKSLTLNLITEMGRLPTFMTQKAKNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDFGLGSITTQQPESNILDIDLRPASAWTLYAVATTFITPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGMTVIDLDPIPYDPKFEKQLGQVMLLVLCVTQVLMMRTTWALCEALTLATGPISTLWEGNPGRFWNTTIAVSMANIFRGSYLAGAGLLFSIMKNTANTRRGTGNTGETLGEKWKNRLNALGKSEFQIYKKSGIQEVDRTLAKEGIKRGETDHHAVSRGSAKLRWFVERNLVTPEGKVVDLGCGRGGWSYYCGGLKNVKEVKGLTKGGPGHEEPIPMSTYGWNLVRLQSGVDVFFTPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESETPNLDIIGKRIEKIKQEHETSWHYDQDHPYKTWAYHGSYETKQTGSASSMVNGVVRLLTKPWDVIPMVTQMAMTDTTPFGQQRVFKEKVDTRTQEPKEGTKKLMKITAEWLWKELGKKKTPRMCTREEFTRKVRSNAALGAIFTDENKWKSAREAVEDSGFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVVTYGLNTFTNMEAQLIRQMEGEGVFKSIQQLTVKEEIAVKNWLIRVGRERLSRMAISGDDCVVKPLDDRFASALTALNDMGKVRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWIPTSRTTWSIHATHEWMTTEDMLTVWNRVWIQENPWMEDKTPVESWEEIPYLGKREDQWCGSLIGLTSRATWAKNIQTAINQVRSLIGNEEYTDYMPSMKRFRREEEEAGVLW

SEQ ID NO: 3825 - protein, 3291 aa, Artificial Sequence
  derived and/or modified protein sequence (wt) from DENV-2__KM279569__SS-prME
TAGIIIMMIPTVMAFHLTTRNGEPHMIVSRQEKGKSLLFKTENGVNMCTLMAMDLGELCEDTITYNCPLLRQNEPEDIDCWCNSTSTWVTYGTCTATGEHRREKRSVALVPHVGMGLETRTETWMSSEGAWKHAQRIETWILRHPGFTIMAAILAYTIGTTYFQRVLIFILLTAVTPSMAMRCIGISNRDFVEGVSGGSWVDIVLEHGSCVTTMAKNKPTLDFELIKTEAKHLATLRKYCVEAKLTNTTTASRCPTQGEPSLNEEQDKRFVCKHSMVDRGWGNGCGLFGKGGIVTCAMFTCKKNMEGKVVQPENLEYTIVITPHSGEENAVGNDTGKHGKEIKVTPQSSITEAELTGYGTVTMECSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRHVLGRLITVNPIVTEKDSPVNIEAEPPFGDSYIIIGVEPGQLKLSWFKKGSSIGQMFETTMRGAKRMAILGDTAWDFGSLGGVFTSIGKALHQVFGAIYGAAFSGVSWTMKILIGVVITWIGMNSRSTSLSVSLVLVGVVTLYLGVMVQADSGCVVSWKNKELKCGSGIFITDNVHTWTEQYKFQPESPSKLASAIQKAHEEGICGIRSVTRLENLMWKQITPELNHILTENEVKLTIMTGDIKGIMQAGKRTLRPQPTELKYSWKAWGKAKMLSTELHNHTFLIDGPETAECPNTNRAWNSLEVEDYGFGVFTTNIWLKLKERQDVFCDSKLMSAAIKDNRAVHADMGYWIESALNDTWKIEKASFIEVKSCHWPKSHTLWSNGVLESEMIIPKNFAGPVSQHNYRPGYHTQTAGPWHLGRLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMTTIGIVLLSQSTIPESILELTDALALGMMVLKIVRNMEKYQLAVTIMAILCVPNAVILQNAWKVSCTTLAVVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVRWEEQAEISGSSPILSITISEDGSMSIKNEEEEQTLTILIRTGLLVISGLFPVSIPITAAAWYLWEVKKQRAGVLWDVPSPPPVGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIVDKKGKVVGLYGNGVVTRSGTYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPIRVPNYNLIIMDEAHFTDPASIAARGYISTRVEMGEAAGIFMTATPPGSRDPFPQSNAPIMDEEKEIPERSWNSGHEWVTDFKGKTVWFVPSIKAGNDIAACLRKNGKKVIQLSRKTFDSEYIKTRTNDWDFVVTTDISEMGANFKAERVIDPRRCMKPVILTDGEERVILAGPMPVTHSSAAQRRGRVGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGVKNNQILEENVEVEIWTKEGERKKLKPRWLDARIYSDPLALKEFKEFAAGRKSLTLNLITEMGRLPTFMTQKAKNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDFGLGSITTQQPESNILDIDLRPASAWTLYAVATTFITPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGMTVIDLDPIPYDPKFEKQLGQVMLLVLCVTQVLMMRTTWALCEALTLATGPISTLWEGNPGRFWNTTIAVSMANIFRGSYLAGAGLLFSIMKNTANTRRGTGNTGETLGEKWKNRLNALGKSEFQIYKKSGIQEVDRTLAKEGIKRGETDHHAVSRGSAKLRWFVERNLVTPEGKVVDLGCGRGGWSYYCGGLKNVKEVKGLTKGGPGHEEPIPMSTYGWNLVRLQSGVDVFFTPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESETPNLDIIGKRIEKIKQEHETSWHYDQDHPYKTWAYHGSYETKQTGSASSMVNGVVRLLTKPWDVIPMVTQMAMTDTTPFGQQRVFKEKVDTRTQEPKEGTKKLMKITAEWLWKELGKKKTPRMCTREEFTRKVRSNAALGAIFTDENKWKSAREAVEDSGFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVVTYGLNTFTNMEAQLIRQMEGEGVFKSIQQLTVKEEIAVKDWLIRVGRERLSRMAISGDDCVVKPLDDRFASALTALNDMGKVRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWIPTSRTTWSIHATHEWMTTEDMLTVWNRVWIQENPWMEDKTPVESWEEIPYLGKREDQWCGSLIGLTSRATWAKNIQTAINQVRSLIGNEEYTDYMPSMKRFRREEEEAGVLW

SEQ ID NO: 3826 - protein, 3291 aa, Artificial Sequence
  derived and/or modified protein sequence (wt) from DENV-2__KM279570__SS-prME
TAGIIIMMIPTVMAFHLTTRNGEPHMIVSRQEKGKSLLFKTENGVNMCTLMAMDLGELCEDTITYNCPLLRQNEPEDIDCWCNSTSTWVTYGTCTATGEHRREKRSVALVPHVGMGLETRTETWMSSEGAWKHAQRIETWILRHPGFTIMAAILAYTIGTTYFQRVLIFILLTAVTPSMAMRCIGISNRDFVEGVSGGSWVDIVLEHGSCVTTMAKNKPTLDFELIKTEAKHLATLRKYCVEAKLTNTTTASRCPTQGEPSLNEEQDKRFVCKHSMVDRGWGNGCGLFGKGGIVTCAMFTCKKNMEGKVVQPENLEYTIVITPHSGEENAVGNDTGKHGKEIKVTPQSSITEAELTGYGTVTMECSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRHVLGRLITVNPIVTEKDSPVNIEAEPPFGDSYIIIGVEPGQLKLSWFKKGSSIGQMFETTMRGAKRMAILGDTAWDFGSLGGVFTSIGKALHQVFGAIYGAAFSGVSWTMKILIGVVITWIGMNSRSTSLSVSLVLVGVVTLYLGVMVQADSGCVVSWKNKELKCGSGIFITDNVHTWTEQYKFQPESPSKLASAIQKAHEEGICGIRSVTRLENLMWKQITPELNHILTENEVKLTIMTGDIKGIMQAGKRSLRPQPTELKYSWKAWGKAKMLSTELHNHTFLIDGPETAECPNTNRAWNSLEVEDYGFGVFTTNIWLKLKERQDVFCDSKLMSAAIKDNRAVHADMGYWIESALNDTWKIEKASFIEVKSCHWPKSHTLWSNGVLESEMIIPKNFAGPVSQHNYRPGYHTQTAGPWHLGRLEMDFDFCEGTTVAVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMTTIGIVLLSQSTIPESILELTDALALGMMVLKIVRNMEKYQLAVTIMAILCVPNAVILQNAWKVSCTTLAVVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVRWEEQAEISGSSPILSITISEDGSMSIKNEEEEQTLTILIRTGLLVISGLFPVSIPITAAAWYLWEVKKQRAGVLWDVPSPPPVGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIVDKKGKVVGLYGNGVVTRSGTYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPIRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYIKTRTNDWDFVVTTDISEMGANFKAERVIDPRRCMKPVILTDGEERVILAGPMPVTHSSAAQRRGRVGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGVKNNQILEENVEVEIWTKEGERKKLKPRWLDARIYSDPLALKEFKEFAAGRKSLTLNLITEMGRLPTFMTQKAKNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDFGLGSITTQQPESNILDIDLRPASAWTLYAVATTFITPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGMTVIDLDPIPYDPKFEKQLGQVMLLVLCVTQVLMMRTTWALCEALTLATGPISTLWEGNPGRFWNTTIAVSMANIFRGSYLAGAGLLFSIMKNTANTRRGTGNTGETLGEKWKNRLNALGKSEFQIYKKSGIQEVDRTLAKEGIKRGETDHHAVSRGSAKLRWFVERNLVTPEGKVVDLGCGRGGWSYYCGGLKNVKEVKGLTKGGPGHEEPIPMSTYGWNLVRLQSGVDVFFTPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESETPNLDIIGKRIEKIKQEHETSWHYDQDHPYKTWAYHGSYETKQTGSASSMVNGVVRLLTKPWDVIPMVTQMAMTDTTPFGQQRVFKEKVDTRTQEPKEGTKKLMKITAEWLWKELGKKKTPRMCTREEFTRKVRSNAALGAIFTDENKWKSAREAVEDSGFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVVTYGLNTFTNMEAQLIRQMEGEGVFKSIQQLTVKEEIAVKNWLIRVGRERLSRMAISGDDCVVKPLDDRFASALTALNDMGKVRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWIPTSRTTWSIHATHEWMTTEDMLTVWNRVWIQENPWMEDKTPVESWEEIPYLGKREDQWCGSLIGLTSRATWAKNIQTAINQVRSLIGNEEYTDYMPSMKRFRREEEEAGVLW

SEQ ID NO: 3827 - protein, 3291 aa, Artificial Sequence
  derived and/or modified protein sequence (wt) from DENV-2__KM279596__SS-prME
TAGIIIMMIPTVMAFHLTTRNGEPHMIVSRQEKGKSLLFKTENGVNMCTLMAMDLGELCEDTITYNCPLLRQNEPEDIDCWCNSTSTWVTYGTCTATGEHRREKRSVALVPHVGMGLETRTETWMSSEGAWKHAQRIETWILRHPGFTIMAAILAYTIGTTYFQRVLIFILLTAVTPSMAMRCIGISNRDFVEGVSGGSWVDIVLEHGSCVTTMAKNKPTLDFELIKTEAKHLATLRKYCVEAKLTNTTTASRCPTQGEPSLNEEQDKRFVCKHSMVDRGWGNGCGLFGKGGIVTCAMFTCKKNMEGKVVQPENLEYTIVITPHSGEENAVGNDTGKHGKEIKVTPQSSITEAELTGYGTVTMECSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRHVLGRLITVNPIVTEKDSPVNIEAEPPFGDSYIIIGVEPGQLKLSWFKKGSSIGQMFETTMRGAKRMAILGDTAWDFGSLGGVFTSIGKALHQVFGAIYGAAFSGVSWTMKILIGVVITWIGMNSRSTSLSVSLVLVGVVTLYLGVMVQADSGCVVSWKNKELKCGSGIFITDNVHTWTEQYKFQPESPSKLASAIQKAHEEGICGIRSVTRLENLMWKQITPELNHILTENEVKLTIMTGDIKGIMQAGKRSLRPQPTELKYSWKAWGKAKMLSTELHNHTFLIDGPETAECPNTNRAWNSLEVEDYGFGVFTTNIWLKLKERQDVFCDSKLMSAAIKDNRAVHADMGYWIESALNDTWKIEKASFIEVKSCHWPKSHTLWSNGVLESEMIIPKNFAGPVSQHNYRPGYHTQTAGPWHLGRLEMDFDFCEGTTVAVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMTTIGIVLLSQSTIPESILELTDALALGMMVLKIVRNMEKYQLAVTIMAILCVPNAVILQNAWKVSCTTLAVVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVRWEEQAEISGSSPILSITISEDGSMSIKNEEEEQTLTILIRTGLLVISGLFPVSIPITAAAWYLWEVKKQRAGVLWDVPSPPPVGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIVDKKGKVVGLYGNGVVTRSGTYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPIRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYIKTRTNDWDFVVTTDISEMGANFKAERVIDPRRCMKPVILTDGEERVILAGPMPVTHSSAAQRRGRVGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGVKNNQILEENVEVEIWTKEGERKKLKPRWLDARIYSDPLALKEFKEFAAGRKSLTLNLITEMGRLPTFMTQKAKNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDFGLGSIATQQPESNILDIDLRPASAWTLYAVATTFITPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGMTVIDLDPIPYDPKFEKQLGQVMLLVLCVTQVLMMRTTWALCEALTLATGPISTLWEGNPGRFWNTTIAVSMANIFRGSYLAGAGLLFSIMKNTANTRRGTGNTGETLGEKWKNRLNALGKSEFQIYKKSGIQEVDRTLAKEGIKRGETDHHAVSRGSAKLRWFVERNLVTPEGKVVDLGCGRGGWSYYCGGLKNVKEVKGLTKGGPGHEEPIPMSTYGWNLVRLQSGVDVFFTPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESETPNLDIIGKRIEKIKQEHETSWHYDQDHPYKTWAYHGSYETKQTGSASSMVNGVVRLLTKPWDVIPMVTQMAMTDTTPFGQQRVFKEKVDTRTQEPKEGTKKLMKITAEWLWKELGKKKTPRMCTREEFTRKVRSNAALGAIFTDENKWKSAREAVEDSGFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVVTYGLNTFTNMEAQLIRQMEGEGVFKSIQQLTVKEEIAVKNWLIRVGRERLSRMAISGDDCVVKPLDDRFASALTALNDMGKVRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWIPTSRTTWSIHATHEWMTTEDMLTVWNRVWIQENPWMEDKTPVESWEEIPYLGKREDQWCGSLIGLTSRATWAKNIQTAINQVRSLIGNEEYTDYMPSMKRFRREEEEAGVLW

SEQ ID NO: 3828 - protein, 3291 aa, Artificial Sequence
  derived and/or modified protein sequence (wt) from DENV-2__FJ850072__SS-prME
TAGVIIMLIPTAMAFHLTTRNGEPHMIVGRQEKGKSLLFKTEDGVNMCTLMAMDLGELCEDTITYKCPLLRQNEPEDIDCWCNSTSTWVTYGTCTTTGEHRREKRSVALVPHVGMGLETRTETWMSSEGAWKHVQRIETWILRHPGFAIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVLPENLEYTIVITPHSGEEHAVGNDTGKHGEEIKITPQSSITEAELTGYGTVTMECSPRTGLDFNEMVLLQMEEKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEIMDLEKRHALGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGVAMTDDIGMGVTYLALLAAFKVRPTFAAGLLLRKLTSKELMMATIGITLLSQSTIPETILELTDALALGMMVLKIVRNMEKYQLAVTIMTISCVPNAMILLNAWKVSCTILAVVSVSPLLLTSSQQKTDWIPLALTIKGLNPTAIFLTTLSRTSKKRSWPLNEAVMAVGMVSILASSLLKNDIPMTGPLVAGGLLTVCYVLTGRSADLELERATDVKWEDQAEISGSSPILSITISEDGSMSIKNEEEEQTLTILIRTGLLVISGVFPVSIPITAAAWYLWEVKKQRAGVLWDVPSPPPVEKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGLFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFRAERVIDPRRCMKPVILTDGEERVILAGPMPVTHSSAAQRRGRVGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGIKNNQILEENVEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFITPMLRHSIENSSVNVSLTAIANQATVLMGLGKGWPLSKMDIGVPLLAIGCYSQVNPITLTAALLSLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKRSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMETLQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMRITAEWLWKELGKKKTPRMCTREEFTRKVRSNAALGAIFTDENKWKSAREAVEDSRFWELVDRERNLHLEGKCETCVYNMMGKREKKLGEFGKAKGSRAIWYMWLGARFLEFEALGFLNEDHWFSRGNSLSGVEGEGLHRLGYILRDVSKKEGGAMYADDTAGWDTRITLEDLKNEEMVTNHMKGEHKKLAEAVFKLTYQNKVVRVQRPTPRGTVMDIISRRDQRGSGQVGTYGLNTFTNMEAQLIRQMEGEGIFKSIQHLTVTEEIAVQNWLARVGRERLSRMAISGDDCVVKPLDDRFASALTALNDMGKVRKDIQQWEPSRGWNDWTQVPFCSHHFHELVMKDGRMLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 3829 - protein, 3291 aa, Artificial Sequence
  derived and/or modified protein sequence (wt) from DENV-2__JN819419__SS-prME
TAGVIVMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCVEAKLTNTTTESRCPTQGEPSLNEEQDKRFICKHSMVDRGWGNGCGLFGKGGIVTCAMFTCKKNMEGKVVQPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEIMDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMATIGVALLSQSTIPETILELTDALALGMMALKIVKNMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVGKAELEDGAYRIKQRGILGYSQIGAGVYKEGTFHTMWHVTRGAVLMHRGKRIEPSWADVKKDLVSYGGGWKLEGEWKEGEEVQVLALEPGKNPRAVQTKPGIFKTNTGNIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRRWCFDGIKNNQILEENVEVEIWTKEGERKKLKPRWLDARIYSDPLALKEFKEFAAGRKSLTLNLITEMGRLPTFMTQKARNALDNLAVLHTAEAGGKAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGKGWPLSKMDIGAPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMETLQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKIPRMCTREEFTRKVRSNAALGAIFTDENKWKSAREAVEDGRFWELVDRERNLHLEGKCETCVYNMMGKREKKLGEFGKAKGSRAIWYMWLGARFLEFEALGFLNEDHWFSRGNSLSGVEGEGLHRLGYILRDVSKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKSIQHLTVTEEIAVQNWLARVGRERLTRMAISGDDCVVKPIDDRFANALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 3830 - protein, 3291 aa, Artificial Sequence
  derived and/or modified protein sequence (wt) from DENV-2__FJ850074__SS-prME
TAGVIVMLIPTVMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTMMAAILAYTIGTTHFQRALIFILLTAVAPSMTMRCIGISNRDFVEGVSGGSWVDIVLEHGSCVTTMAKNKPTLDFELIKTEAKQPATLRKYCVEAKLTNTTTESRCPTQGEPSLNEEQDKRFICKHSMVDRGWGNGCGLFGKGGIVTCAMFTCKKNMEGKVVQPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEIMDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLPTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMATIGVALLSQSTIPETILELTDALALGMMALKIVKNMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVGKAELEDGAYRIKQRGILGYSQIGAGVYKEGTFHTMWHVTRGAVLMHRGKRIEPSWADVKKDLVSYGGGWKLEGEWKEGEEVQVLALEPGKNPRAVQTKPGIFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRSNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRRWCFDGIKNNQILEENVEVEIWTKEGERKKLKPRWLDARIYSDPLALKEFKEFAAGRKSLTLNLITEMGRLPTFMTQKARNALDNLAVLHTAEAGGKAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMETLQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDGRFWELVDRERNLHLEGKCETCVYNMMGKREKKLGEFGKAKGSRAIWYMWLGARFLEFEALGFLNEDHWFSRGNSLSGVEGEGLHRLGYILRDVSKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKSIQHLTVTEEIAVQNWLARVGRERLTRMAISGDDCVVKPIDDRFANALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 3831 - protein, 3291 aa, Artificial Sequence
  derived and/or modified protein sequence (wt) from DENV-2__FJ850076__SS-prME
TAGAIVMLIPTVMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTMMAAILAYTIGTTHFQRALIFILLTAVAPSMTMRCIGISNRDFVEGVSGGSWVDIVLEHGSCVTTMAKNKPTLDFELIKTEAKQPATLRKYCVEAKLTNTTTESRCPTQGEPSLNEEQDKRFICKHSMVDRGWGNGCGLFGKGGIVTCAMFTCKKNMEGKVVQPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEIMDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLPTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMATIGVALLSQSTIPETILELTDALALGMMALKIVKNMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDVPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVGKAELEDGAYRIKQRGILGYSQIGAGVYKEGTFHTMWHVTRGAVLMHRGKRIEPSWADVKKDLVSYGGGWKLEGEWKEGEEVQVLALEPGKNPRAVQTKPGIFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRSNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRRWCFDGIKNNQILEENVEVEIWTKEGERKKLKPRWLDARIYSDPLALKEFKEFAAGRKSLTLNLITEMGRLPTFMTQKARNALDNLAVLHTAEAGGKAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMETLQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDGRFWELVDRERNLHLEGKCETCVYNMMGKREKKLGEFGKAKGSRAIWYMWLGARFLEFEALGFLNEDHWFSRGNSLSGVEGEGLHRLGYILRDVSKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKSIQHLTVTEEIAVQNWLARVGRERLTRMAISGDDCVVKPIDDRFANALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 3832 - protein, 3291 aa, Artificial Sequence
  derived and/or modified protein sequence (wt) from DENV-2__GQ868640__SS-prME
TAGAIVMLIPTVMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTMMAAILAYTIGTTHFQRALIFILLTAVAPSMTMRCIGISNRDFVEGVSGGSWVDIVLEHGSCVTTMAKNKPTLDFELIKTEAKQPATLRKYCVEAKLTNTTTESRCPTQGEPSLNEEQDKRFICKHSMVDRGWGNGCGLFGKGGIVTCAMFTCKKNMEGKVVQPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEIMDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLPTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATITDDIGMGVTYLALLAAFKVRPTFAAGLLLRKLTSKELMMATIGVALLSQSTIPETILELTDALALGMMALKIVKNMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDVPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVGKAELEDGAYRIKQRGILGYSQIGAGVYKEGTFHTMWHVTRGAVLMHRGKRIEPSWADVKKDLVSYGGGWKLEGEWKEGEEVQVLALEPGKNPRAVQTKPGIFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRSNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRRWCFDGIKNNQILEENVEVEIWTKEGERKKLKPRWLDARIYSDPLALKEFKEFAAGRKSLTLNLITEMGRLPTFMTQKARNALDNLAVLHTAEAGGKAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMETLQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDGRFWELVDRERNLHLEGKCETCVYNMMGKREKKLGEFGKAKGSRAIWYMWLGARFLEFEALGFLNEDHWFSRGNSLSGVEGEGLHRLGYILRDVSKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKSIQHLTVTEEIAVQNWLARVGRERLTRMAISGDDCVVKPIDDRFANALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 3833 - protein, 3291 aa, Artificial Sequence
  derived and/or modified protein sequence (wt) from DENV-2__FJ850078__SS-prME
TAGVIVMLIPTVMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTMMAAILAYTIGTTHFQRALIFILLTAVAPSMTMRCIGISNRDFVEGVSGGSWVDIVLEHGSCVTTMAKNKPTLDFELIKTEAKQPATLRKYCVEAKLTNTTTESRCPTQGEPSLNEEQDKRFICKHSMVDRGWGNGCGLFGKGGIVTCAMFTCKKNMEGKVVQPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEIMDLEKRHVLGRLITVNPIVTEKDSPVNIEAEPPFGDSYIIVGVEPGQLKLNWFKKGSSIGQMFETTMRGAKRMAILGDTAWDFGSLGGVFTSIGKALHQVFGAIYGAAFNGVSWTMKILIGVIITWIGMNSRSTSLSVSLVLVGVVTLYLGAMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLPTESHNQTFLIDGPETAECPNANRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMATIGVALLSQSTIPETILELTDALALGMMALKIVKNMEKYQLAVTIMAISCVPNAVILQNAWKVSCTILAAVSVSPLLLTSSQQKADWIPLALTIKGLNPTAIFLTTLSRTSKKRSWPLNEAVMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVEKAELEDGAYRIKQRGILGYSQIGAGVYKEGTFHTMWHVTRGAVLMHRGKRIEPSWADVKKDLVSYGGGWKLEGEWKEGEEVQVLALEPGKNPRAVQTKPGIFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRSNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRRWCFDGIKNNQILEENVEVEIWTKEGERKKLKPRWLDARIYSDPLALKEFKEFAAGRKSLTLNLITEMGRLPTFMTQKARNALDNLAVLHTAEAGGKAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTRGGPGHEEPIPMSTYGWNLVRLQSGVDVFFTPPEKCDTLLCDIGESSPNPTIEAGRTLRVLNLVENWLNNNTQFCIKVLNPYMPSVIEKMETLQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDGRFWELVDRERNLHLEGKCETCVYNMMGKREKKLGEFGKAKGSRAIWYMWLGARFLEFEALGFLNEDHWFSRGNSLSGVEGEGLHRLGYILRDVSKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKSIQHLTVTEEIAVQNWLARVGRERLTRMAISGDDCVVKPIDDRFANALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 3834 - protein, 3291 aa, Artificial Sequence
  derived and/or modified protein sequence (wt) from DENV-2__FJ850082__SS-prME
TVGVIVMLIPTAMAFHLTTRNGEPHMIVGRQEKGKSLLFKTENGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCVEAKLTNTTTESRCPTQGEPSLNEEQDKRFICKHSMVDRGWGNGCGLFGKGGIVTCAMFTCKKNMEGKVVQPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEIMDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLREKQDVFCDSKLMSAAVKDNRAVHADMGYWIESALNDTWKMEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMATIGVALLSQSTIPETILELTDALALGMMALKIVKNMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVGKAELEEGAYRIKQRGILGYSQIGAGVYKEGTFHTMWHVTRGAVLMHRGKRIEPSWADVKKDLVSYGGGWKLEGEWKEGEEVQVLALEPGKNPRAVQTKPGIFKTNTGTIGAVSLDFSPGTSGSPIVDRKGKVVGLYGNGVVTRSGAYVSAIAQTDKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRRWCFDGIKNNQILEENVEVEIWTKEGERKKLKPRWLDARIYSDPLALKEFKEFAAGRKSLTLNLITEMGRLPTFMTQKARNALDNLAVLHTAEAGGKAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMETLQRKYGGALVRNPLSRNSTHEMYWVSNATGNIVSSVNMISRMLINRFTMKHKKATYEPDVDLGSGTRNIGIESEVPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKIPRMCTREEFTRKVRSNAALGAIFTDENKWKSAREAVEDGRFWELVDRERNLHLEGKCETCVYNMMGKREKKLGEFGKAKGSRAIWYMWLGARFLEFEALGFLNEDHWFSRGNSLSGVEGEGLHRLGYILRDVSKKEGGAMYADDTAGWDTRITLEDLKNEEMITNHMKGEHKKLAEAIFKLTYQNKVVRVQRPTPRGTVMDIISRRDQRGSGQVGTYGLNTFTNMEAQLIRQMEGEGIFKSIQHLTVTEEIAVQNWLARVGRERLTRMAISGDDCVVKPIDDRFANALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEGYTDYMPSMKRFRREEEEAGVLW

SEQ ID NO: 3835 - protein, 3291 aa, Artificial Sequence
  derived and/or modified protein sequence (wt) from DENV-2__FJ850085__SS-prME
TVGVIVMLIPTAMAFHLTTRNGEPHMIVGRQEKGKSLLFKTENGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCVEAKLTNTTTESRCPTQGEPSLNEEQDKRFICKHSMVDRGWGNGCGLFGKGGIVTCAMFTCKKNMEGKVVQPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEIMDLEKRHVLGRLITVNPIVAEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLREKQDVFCDSKLMSAAVKDNRAVHADMGYWIESALNDTWKMEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMATIGVALLSQSTIPETILELTDALALGMMALKIVKNMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVGKAELEEGAYRIKQRGILGYSQIGAGVYKEGTFHTMWHVTRGAVLMHRGKRIEPSWADVKKDLVSYGGGWKLEGEWKEGEEVQVLALEPGKNPRAVQTKPGIFKTNTGTIGAVSLDFSPGTSGSPIVDRKGKVVGLYGNGVVTRSGAYVSAIAQTDKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRRWCFDGIKNNQILEENVEVEIWTKEGERKKLKPRWLDARIYSDPLALKEFKEFAAGRKSLTLNLITEMGRLPTFMTQKARNALDNLAVLHTAEAGGKAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMETLQRKYGGALVRNPLSRNSTHEMYWVSNATGNIVSSVNMISRMLINRFTMKHKKATYEPDVDLGSGTRNIGIESEVPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKIPRMCTREEFTRKVRSNAALGAIFTDENKWKSAREAVEDGRFWELVDRERNLHLEGKCETCVYNMMGKREKKLGEFGKAKGSRAIWYMWLGARFLEFEALGFLNEDHWFSRGNSLSGVEGEGLHRLGYILRDVSKKEGGAMYADDTAGWDTRITLEDLKNEEMITNHMKGEHKKLAEAIFKLTYQNKVVRVQRPTPRGTVMDIISRRDQRGSGQVGTYGLNTFTNMEAQLIRQMEGEGIFKSIQHLTVTEEIAVQNWLARVGRERLTRMAISGDDCVVKPIDDRFANALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEGYTDYMPSMKRFRREEEEAGVLW

SEQ ID NO: 3836 - protein, 3291 aa, Artificial Sequence
  derived and/or modified protein sequence (wt) from DENV-2__FJ850088__SS-prME
TAGVIVMLIPTVMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTMMAAILAYTIGTTHFQRALIFILLTAVAPSMTMRCIGISNRDFVEGVSGGSWVDIVLEHGSCVTTMAKNKPTLDFELIKTEAKQPATLRKYCVEAKLTNTTTESRCPTQGEPSLNEEQDKRFICKHSMVDRGWGNGCGLFGKGGIVTCAMFTCKKNMEGKVVQPENLEYTIVITPHSGEEHAVGNDTGKHGKEVKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEIMDLEKRHVLGRLITVNPIVTEKDSPVNIEAEPPFGDSYIIVGVEPGQLKLNWFKKGSSIGQMFETTMRGAKRMAILGDTAWDFGSLGGVFTSIGKALHQVFGAIYGAAFNGVSWTMKILIGVIITWIGMNSRSTSLSVSLVLVGVVTLYLGAMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLPTESHNQTFLIDGPETAECPNANRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSLVTLITGNMSFRDLGRVMVMVGATMTDDIGMGVTYLALLAAFKVRPTFAAGLLLRKLTSKELMMATIGVALLSQSTIPETILELTDALALGMMALKVVKNMEKYQLAVTIMAISCVPNAVILQNAWKVSCTILAAVSVSPLLLTSSQQKADWIPLALTIKGLNPTAIFLTTLSRTSKKRSWPLNEAVMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVEKAELEDGAYRIKQRGILGYSQIGAGVYKEGTFHTMWHVTRGAVLMHRGKRIEPSWADVKKDLVSYGGGWKLEGEWKEGEEVQVLALEPGKNPRAVQTKPGIFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRSNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRRWCFDGIKNNQILEENVEVEIWTKEGERKKLKPRWLDARIYSDPLALKEFKEFAAGRKSLTLNLITEMGRLPTFMTQKARNALDNLAVLHTAEAGGKAYNHALSELPETLETLLLLALLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSVMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTRGGPGHEEPIPMSTYGWNLVRLQSGVDVFFTPPEKCDTLLCDIGESSPNPTIEAGRTLRVLNLVENWLNNNTQFCIKVLNPYMPSVIEKMETLQRTYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDGRFWELVDRERNLHLEGKCETCVYNMMGKREKKLGEFGKAKGSRAIWYMWLGARFLEFEALGFLNEDHWFSRGNSLSGVEGEGLHRLGYILRDVSRKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKSIQHLTVTEEIAVQNWLARVGRERLTRMAISGDDCVVKPIDDRFANALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 3837 - protein, 3291 aa, Artificial Sequence
  derived and/or modified protein sequence (wt) from DENV-2__FJ850091__SS-prME
TAGVIVMLIPTAMAFHLTTRNGEPHMIVGRQEKGKSLLFKTEDGVNMCTLMAMDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKIVQPENLEYTIVITPHSGEEHAVGNDTGKHGKEIKITPQSSTTEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEITDLEKRHVLGRLITVNPIVTEKDSPVNIEAEPPFGDSYIIVGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAMVQADSGCIVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVALSFVTLITGNMSFRDLGRVMVMVGATMTDDIGMGVTYLALLAAFKVRPTFAAGLLLRKLTSKELMMATIGIALLSQSTLPETILELTDALALGMMALKIVRNMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRAADLELERAADVKWEDQAEISGSSPILSITISEDGSMSIKNEEEEQTLTILIRTGLLVISGVFPVSIPITAAAWYLWEVKKQRAGVLWDVPSPPPVGKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGIFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYAKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRKWCFDGIKNNQILEENVEVEIWTKEGERKKLKPRWLDARIYSDPLALKEFKEFAAGRKSLTLNLITEMGRLPTFMTQKARNALDNLAVLHTAEVGGKAYTHALSELPETLETLLLLTLLAAVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGFGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNVGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMETLQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKEKTPRMCTREEFTRKVRSNAALGAVFTDENKWKSAREAVEDGRFWELVDRERNLHLEGKCETCVYNMMGKREKKLGEFGKAKGSRAIWYMWLGARFLEFEALGFLNEDHWFSRGNSLSGVEGEGLHRLGYILREVGKKEGGAMYADDTAGWDTRITLEDLKNEEMVTNHMKGEHKKLAEAIFKLTYQNKVVRVQRPTPRGTVMDIISRKDQRGSGQVGTYGLNTFTNMEAQLIRQMEGEGIFKSIQHLTATEEIAVQNWLARVGRERLSRMAISGDDCVVKPIDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEGYTDYMPSMKRFRREEEEAGVLW

SEQ ID NO: 3838 - protein, 3291 aa, Artificial Sequence
  derived and/or modified protein sequence (wt) from DENV-2__GQ199890__SS-prME
TAGVIVMLIPTAMAFHLTTRNGEPHMIVGRQEKGKSLLFKTEDGVNMCTLMAIDLGELCEDTITYKCPLLRQNEPEDIDCWCNSTSTWVTYGTCTTIGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKIVQPENLEYTIVITPHSGEERAVGNDTGKHGKEIKITPQSSTTEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEITDLEKRHVLGRLITVNPIVTEKDSPVNIEAEPPFGDSYIIVGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAMVQADSGCIVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVALSFVTLITGNMSFRDLGRVMVMVGATMTDDIGMGVTYLALLAAFKVRPTFAAGLLLRKLTSKELMMATIGIALLSQSTLPETILELTDALALGMMALKIVRNMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVGKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGIFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRKWCFDGIKNNQILEENVEVEIWTKEGERKKLKPRWLDARIYSDPLALKEFKEFAAGRKSLTLNLITEMGRLPTFMTQKARNALDNLAVLHTAEVGGKAYTHALSELPETLETLLLLTLLATITGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGFGTITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNVGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMETLQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKEKTPRMCTREEFTRKVRSNAALGAIFTDENKWKSAREAVEDGRFWELVDRERNLHLEGKCETCVYNMMGKREKKLGEFGKAKGSRAIWYMWLGARFLEFEALGFLNEDHWFSRGNSLSGVEGEGLHRLGYILREVGKKEGGAMYADDTAGWDTRITLEDLKNEEMVTNHMKGEHKKLAEAIFKLTYQNKVVRVQRPTPRGTVMDIISRKDQRGSGQVGTYGLNTFTNMEAQLIRQMEGEGIFKSIQHLTATEEIAVQNWLARVGRERLSRMAISGDDCVVKPIDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEGYTDYMPSMKRFRKEEEEAGVLW

SEQ ID NO: 3839 - protein, 3291 aa, Artificial Sequence
  derived and/or modified protein sequence (wt) from DENV-2__GQ868549__SS-prME
TAGVIVMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKIVQPENLEYTIVITPHSGEEHAVGNDTGKHGKEIKITPQSSTTEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEITDLEKRHVLGRLITVNPIVTEKDSPVNIEAEPPFGDSYIIVGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAMVQADSGCIVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVALSFVTLITGNMSFRDLGRVMVMVGATMTDDIGMGVTYLALLAAFKVRPTFAAGLLLRKLTSKELMMATIGIALLSQSTLPETILELTDALALGMMALKIVRNMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVGKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGIFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRKWCFDGIKNNQILEENVEVEIWTKEGERKKLKPRWLDARIYSDPLALKEFKEFAAGRKSLTLNLITEMGRLPTFMTQKARNALDNLAVLHTAEVGGKAYTHALSELPETLETLLLLTLLAAVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGFGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNVGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMETLQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKEKTPRMCTREEFTRKVRSNAALGAVFTDENKWKSAREAVEDGRFWELVDRERNLHLEGKCETCVYNMMGKREKKLGEFGKAKGSRAIWYMWLGARFLEFEALGFLNEDHWFSRGNSLSGVEGEGLHRLGYILREVGKKEGGAMYADDTAGWDTRITLEDLKNEEMVTNHMKGEHKKLAEAIFKLTYQNKVVRVQRPTPRGTVMDIISRKDQRGSGQVGTYGLNTFTNMEAQLIRQMEGEGIFKSIQHLTATEEIAVQNWLARVGRERLSRMAISGDDCVVKPIDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLMGNEGYTDYMPSMKRFRREEEEAGVLW

SEQ ID NO: 3840 - protein, 3291 aa, Artificial Sequence
  derived and/or modified protein sequence (wt) from DENV-2__GQ868551__SS-prME
TAGVIVMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKIVQPENLEYTIVITPHSGEEHAVGNDTGKHGKEIKITPQSSTTEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEITDLEKRHVLGRLITVNPIVTEKDSPVNIEAEPPFGDSYIIVGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAMVQADSGCIVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKVKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVALSFVTLITGNMSFRDLGRVMVMVGATMTDDIGMGVTYLALLAAFKVRPTFAAGLLLRKLTSKELMMATIGIALLSQSTLPETILELTDALALGMMALKIVRNMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVGKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGIFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRKWCFDGIKNNQILEENVEVEIWTKEGERKKLKPRWLDARIYSDPLALKEFKEFAAGRKSLTLNLITEMGRLPTFMTQKARNALDNLAVLHTAEVGGKAYTHALSELPETLETLLLLTLLAAVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGFGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNVGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMETLQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKEKTPRMCTREEFTRKVRSNAALGAVFTDENKWKSAREAVEDGRFWELVDRERNLHLEGKCETCVYNMMGKREKKLGEFGKAKGSRAIWYMWLGARFLEFEALGFLNEDHWFSRGNSLSGVEGEGLHRLGYILREVGKKEGGAMYADDTAGWDTRITLEDLKNEEMVTNHMKGEHKKLAEAIFKLTYQNKVVRVQRPTPRGTVMDIISRKDQRGSGQVGTYGLNTFTNMEAQLIRQMEGEGIFKSIQHLTATEEIAVQNWLARVGRERLSRMAISGDDCVVKPIDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLMGNEGYTDYMPSMKRFRREEEEAGVLW

SEQ ID NO: 3841 - protein, 3291 aa, Artificial Sequence
  derived and/or modified protein sequence (wt) from DENV-2__HM181971__SS-prME
TAGVIVMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKIVQPENLEYTIVITPHSGEEHAVGNDTGKHGKEIKITPQSSTTEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEITDLEKRHVLGRLITVNPIVTEKDSPVNIEAEPPFGDSYIIVGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAMVQADSGCIVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEIDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVALSFVTLITGNMSFRDLGRVMVMVGATMTDDIGMGVTYLALLAAFKVRPTFAAGLLLRKLTSKELMMATIGIALLSQSTLPETILELTDALALGMMALKIVRNMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVGKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGIFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRKWCFDGIKNNQILEENVEVEIWTKEGERKKLKPRWLDARIYSDPLALKEFKEFAAGRKSLTLNLITEMGRLPTFMTQKARNALDNLAVLHTAEVGGKAYTHALSELPETLETLLLLTLLAAVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGFGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNVGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMETLQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKEKTPRMCTREEFTRKVRSNAALGAVFTDENKWKSAREAVEDGRFWELVDRERNLHLEGKCETCVYNMMGKREKKLGEFGKAKGSRAIWYMWLGARFLEFEALGFLNEDHWFSRGNSLSGVEGEGLHRLGYILREVGKKEGGAMYADDTAGWDTRITLEDLKNEEMVTNHMKGEHKKLAEAIFKLTYQNKVVRVQRPTPRGTVMDIISRKDQRGSGQVGTYGLNTFTNMEAQLIRQMEGEGIFKSIQHLTATEEIAVQNWLARVGRERLSRMAISGDDCVVKPIDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLMGNEGYTDYMPSMKRFRREEEEAGVLW

SEQ ID NO: 3842 - protein, 3291 aa, Artificial Sequence
  derived and/or modified protein sequence (wt) from DENV-2__GU131881__SS-prME
TAGVIVMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKIVQPENLEYTIVITPHSGEEHAVGNDTGKHGKEIKITPQSSTTEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEITDLEKRHVLGRLITVNPIVTEKDSPVNIEAEPPFGDSYIIVGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAMVQADSGCIVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKNNRAVHADMGYWIESALNDTWKMEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVALSFVTLITGNMSFRDLGRVMVMVGATMTDDIGMGVTYLALLAAFKVRPTFAAGLLLRKLTSKELMMATIGIALLSQSTLPETILELTDALALGMMALKIVRNMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVGKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGIFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRKWCFDGIKNNQILEENVEVEIWTKEGERKKLKPRWLDARIYSDPLALKEFKEFAAGRKSLTLNLITEMGRLPTFMTQKARNALDNLAVLHTAEVGGKAYTHALSELPETLETLLLLTLLAAVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGFGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNVGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMETLQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKEKTPRMCTREEFTRKVRSNAALGAVFTDENKWKSAREAVEDGRFWELVDRERNLHLEGKCETCVYNMMGKREKKLGEFGKAKGSRAIWYMWLGARFLEFEALGFLNEDHWFSRGNSLSGVEGEGLHRLGYILREVGKKEGGAMYADDTAGWDTRITLEDLKNEEMVTNHMKGEHKKLAEAIFKLTYQNKVVRVQRPTPRGTVMDIISRKDQRGSGQVGTYGLNTFTNMEAQLIRQMEGEGIFKSIQHLTATEEIAVQNWLARVGRERLSRMAISGDDCVVKPIDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEGYTDYMPSMKRFRREEEEAGVLW

SEQ ID NO: 3843 - protein, 3291 aa, Artificial Sequence
  derived and/or modified protein sequence (wt) from DENV-2__FJ898461__SS-prME
TAGVIVMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVQPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEITDLEKRHVLGRLITVNPIVTEKDSPVNIEAEPPFGDSYIIIGVEPGQLKLNWFKKGSSIGQMFQTTVRGAKRMAILGDTAWDFGSLGGVFTSIGKALHQVFGAIYGAAFSGVSWTMKILIGVIITWIGMNSRSTSLSVSLVLVGVVTLYLGAMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDLCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRIGTKHAILLVVVSFVTLITGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVEKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGIFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIKTEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRKWCFDGIKNNQILEENMEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQEPESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMETLQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDGRFWELVDRERNLHLEGKCETCVYNMMGKREKKLGEFGKAKGSRAIWYMWLGARFLEFEALGFLNEDHWFSRGNSLSGVEGEGLHRLGYILRDVGKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKSIQHLTATEEIAVQNWLARLGRERLSRMAISGDDCVVKPIDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 3844 - protein, 3291 aa, Artificial Sequence
  derived and/or modified protein sequence (wt) from DENV-2__FJ024473__SS-prME
TAGVIVMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGTSNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVQPENLEYTIVITPHSGEEHAVGDDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEITDLEKRHVLGRLITVNPIVIEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVVITWIGMNSRSTSLSVSLVLVGVVTLYLGAMVQADSGCVVSWKNKELKCGSGIFITDNVHTWTEQYKFQPESPSKLASAIQKAHEEGICGIRSVTRLENLMWKQITPELNHILSENEVKLTIMTGDTKGIMQAGKRYLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMATIGITLLSQSTIPETILELTDALALGMMVLKIVRNMEKYQLAVTIMAISCVPNAVILRNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEETTLTILIRTGLLVISGVFPVSIPITAAAWYLWEVKKQRAGVLWDVPSPPLVGKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGIFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIKAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAVDGEYRLRGEARKTFVDLMRRGDLPVWLAYKVAAEGINYADRKWCFDGIKNNQILEENVEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASVLLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMETLQRKYGGALVRNPLSRNSTHEMYWVSNATGNIVSSVNMISRMLINRFTMKHKKATYEADVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMRITAEWLWKELGKKKTPRMCTREEFTRKVRSNAALGAIFTDENKWKSAREAVEDGRFWELVDRERNLHLEGKCETCVYNMMGKREKKLGEFGKAKGSRAIWYMWLGARFLEFEALGFLNEDHWFSRGNSLSGVEGEGLHRLGYILRDVGKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKSIQHLTATEEIAAQNWLARVGRERLSRMAISGDDCVVKPIDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 3845 - protein, 3291 aa, Artificial Sequence
  derived and/or modified protein sequence (wt) from DENV-2__FJ024474__SS-prME
TAGVIVMLIPTAMAFHLTTRNGEPHMIVGRQEKGKSLLFKTEDGVNMCTLMAIDLGELCEDTITYKCPLLKQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVQPENLEYTIVITPHSGEEHAVGNDIGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEITDLEKRHVLGRLITVNPIVIEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVVITWIGMNSRSTSLSVSLVLVGVVTLYLGAMVQADSGCVVSWKNKELKCGSGIFITDNVHTWTEQYKFQPESPSKLASAIQKAHEEGICGIRSVTRLENLMWKQITPELNHILSENEVKLTIMTGDTKGIMQAGKRYLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMATIGITLLSQSTIPETILELTDALALGMMVLKIVRNMEKYQLAVTIMAISCVPNAVILRNAWKVSCTILAAASVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQILTILIRTGLLVISGVFPVSIPITAAAWYLWEVKKQRAGVLWDVPSPPPVGKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGIFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIKAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTHGEERVILAGPMPVTHSSAAQRRGRIGRNPKNENDQYIYMGEPLENDEDCAHWKEAKMLLDNINTPEGIIPSMFEPEREKVDAVDGEYRLRGEARKTFVDLMRRGDLPVWLAYKVAAEGINYADRKWCFDGIKNNQILEENVEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASVLLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMETLQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMRITAEWLWKELGKKKTPRMCTREEFTRKVRSNAALGAIFTDENKWKSAREAVEDGRFWELVDRERNLHLEGKCETCVYNMMGKREKKLGEFGKAKGSRAIWYMWLGARFLEFEALGFLNEDHWFSRGNSLSGVEGEGLHRLGYILRDVGKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKSIQHLTATEEIAAQNWLARVGRERLSRMAISGDDCVVKPIDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 3846 - protein, 3291 aa, Artificial Sequence
  derived and/or modified protein sequence (wt) from DENV-2__FJ024475__SS-prME
TAGVIVMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVQPENLEYTIVITPHSGEEHAVGDDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEITDLEKRHVLGRLITVNPIVIEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVVITWIGMNSRSTSLSVSLVLVGVVTLYLGAMVQADSGCVVSWKNKELKCGSGIFITDNVHTWTEQYKFQPESPSKLASAIQKAHEEGICGIRSVTRLENLMWKQITPELNHILSENEVKLTIMTGDTKGIMQAGKRYLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMATIGITLLSQSTIPETILELTDALALGMMVLKIVRNMEKYQLAVTIMAISCVPNAVILRNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEETTLTILIRTGLLVISGVFPVSIPITAAAWYLWEVKKQRAGVLWDVPSPPPVGKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGIFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIKAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAVDGEYRLRGEARKTFVDLMRRGDLPVWLAYKVAAEGINYADRKWCFDGIKNNQILEENVEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASVLLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGKGWPLSKMDIGVPLLAIGCYSQVNPMTLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMETLQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMRITAEWLWKELGKKKTPRMCTREEFTRKVRSNAALGAIFTDENKWKSAREAVEDGRFWELVDRERNLHLEGKCETCVYNMMGKREKKLGEFGKAKGSRAIWYMWLGARFLEFEALGFLNEDHWFSRGNSLSGVEGEGLHRLGYILRDVGKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKSIQHLTATEEIAAQNWLARVGRERLSRMAISGDDCVVKPIDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 3847 - protein, 3288 aa, Artificial Sequence
  derived and/or modified protein sequence (wt) from DENV-2__FJ182012__SS-prME
TAGVIVMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVQPENLEYTIVITPHSGEEHAVGNDNGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEITDLEKRHVLGRLITVNPIVIEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVVITWIGMNSRSTSLSVSLVLVGVVTLYLGAMVQADSGCVVSWKNKELKCGSGIFITDNVHTWTEQYKFQPESPSKLASAIQKAHEEGICGIRSVTRLENLMWKQITPELNHILSENEVKLTIMTGDTKGIMQAGKRYLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMATIGITLLSQSTIPETILELTDALALGMMVLKIVRNMEKYQLAVTIMAISCVPNAVILRNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQILTILIRTGLLVISGVFPVSIPITAAAWYLWEVKKQRAGVLWDVPSPPPVGKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGIFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIKAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTHGEERVILAGPMPVTHSSAAQRRGRIGRNPKNENDQYIYMGEPLENDEDCAHWKEAKMLLDNINTPEGIIPSMFEPEREKVDAVDGEYRLRGEARKTFVDLMRRGDLPVWLAYKVAAEGINYADRKWCFDGIKNNQILEENVEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASVLLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGKGWPLSKMDIGVPLLAIGCYSQVNPITLTAALLSLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMETLQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMRITAEWLWKELGKKKTPRMCTREEFTRKVRSNAALGAIFTDENKWKSAREAVEDGRFWELVDRERNLHLEGKCETCVYNMMGKREKKLGEFGKAKGSRAIWYMWLGARFLEFEALGFLNEDHWFSRGNSLSGVEGEGLHRLGYILRDVGKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKSIQHLTATEEIAAQNWLARVGRERLSRMAISGDDCVVKPIDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 3848 - protein, 3291 aa, Artificial Sequence
  derived and/or modified protein sequence (wt) from DENV-2__EU854293__SS-prME
TAGMIIMLIPTVMAFHLTTRNGEPHMIVSRQEKGKSLLFKTGDGVNMCTLMAMDLGELCEDTITYKCPLLRQNEPEDIDCWCNSTSTWVTYGTCTTTGEHRREKRSVALVPHVGMGLETRTETWMSSEGAWKHAQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQSATLRKYCIEAKLTNTTTESRCPTQGEPSLNEEQDKRFVCKHSMVDRGWGNGCGLFGKGGIVTCAMFTCKKNMKGKVVQPENLEYTIVITPHSGEEHAVGNDTGKHGKEIKITPQSSITEAELTGYGTVTMECSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGVMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKIEKASFIEVKSCHWPKSHTLWSNEVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMTTIGIVLLSQSTIPETILELTDALALGMMVLKMVRKMEKYQLAVTIMAILCVPNAVILQNAWKVSCTILAVVSVSPLFLTSSQQKADWIPLALTIKGLNPTAIFLTTLSRTNKKRSWPLNEAIMAVGMVSILASSLLKNDIPMTGPLVAGGLLTVCYVLTGRSADLELERAADVKWEDQAEISGSSPILSITISEDGSMSIKNEEEEQILTILIRTGLLVISGLFPVSMPITAAAWYLWEVKKQRAGVLWDVPSPPPVGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNAGTIGAVSLDFSPGTSGSPIIDKKGKVVGLYGNGVVTRSGAYVSAIAQTEKSIEDNPEIEDDIFRKRKLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWSSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGIKNNQILEENVEVEIWTKEGERKKLKPRWLDARIYSDPLALKEFKEFAAGRKSLTLNLITEMGRLPTFMTQKARDALDNLAVLHTAEAGGRAYNHALSELPETLETLLLLTLLATVTGGIFLFLMSGRGIGKMTLGMCCIITASILLWYAQIQPHWIAASIILEFFLIVLLIPEPEKQRTPQDNQLTYVVIAILTVVAATMANEMGFLEKTKKDLGLGSITTQQPESNILDIDLRPASAWTLYAVATTFVTPMLRHSIENSSVNVSLTAIANQATVLMGLGKGWPLSKMDIGVPLLAIGCYSQVNPITLTAALFLLVAHYAIIGPGLQAKATREAQKRAAAGIMKNPTVDGITVIDLDPIPYDPKFEKQLGQVMLLVLCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKSIQHLTVTEEIAVQNWLARVGRERLSRMAISGDDCVVKPLDDRFASALTALNDMGKVRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIQENPWMEDKTPVESWEEIPYLGKREDQWCGSLIGLTSRATWAKNIQTAINQVRSLIGNEEYTDYMPSMKRFRREEEEAGVLW

SEQ ID NO: 3849 - protein, 3291 aa, Artificial Sequence
  derived and/or modified protein sequence (wt) from DENV-2__EU854294__SS-prME
TAGVIVMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVQPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEITDLEKRHVLGRLITVNPIVIEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVVITWIGMNSRSTSLSVSLVLVGVVTLYLGAMVQADSGCVVSWKNKELKCGSGIFITDNVHTWTEQYKFQPESPSKLASAIQKAHEEGICGIRSVTRLENLMWKQITPELNHILSENEVKLTIMTGDTKGIMQAGKRYLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMATIGITLLSQSTIPETILELTDALALGMMVLKIVRNMEKYQLAVTIMAISCVPNAVILRNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVGKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGIFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIKAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAVDGEYRLRGEARKTFVDLMRRGDLPVWLAYKVAAEGINYADRKWCFDGIKNNQILEENVEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASVLLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMETLQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMRITAEWLWKELGKKKTPRMCTREEFTRKVRSNAALGAIFTDENKWKSAREAVEDGRFWELVDRERNLHLEGKCETCVYNMMGKREKKLGEFGKAKGSRAIWYMWLGARFLEFEALGFLNEDHWFSRGNSLSGVEGEGLHRLGYILRDVGKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKSIQHLTATEEIAAQNWLARVGRERLSRMAISGDDCVVKPIDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 3850 - protein, 3291 aa, Artificial Sequence
  derived and/or modified protein sequence (wt) from DENV-2__FJ024477__SS-prME
TAGVIVMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVQPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEITDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAMVQADSGCVVSWKNKELKCGSGIFITDNVHTWTEQYKFQPESPSKLASAIQKAHEEGICGIRSATRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLAAVSFVTLITGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLAVTIMAISCVPNAVILQNAWKVSCTILAVVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVGKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGIFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIKAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRKWCFDGIKNNQILEENVEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASVLLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMETLQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDGRFWELVDRERNLHLEGKCETCVYNMMGKREKKLGEFGKAKGSRAIWYMWLGARFLEFEALGFLNEDHWFSRGNSLSGVEGEGLHRLGYILRDVSKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKSIQHLTATEEIAVQNWLARVGRERLSRMAISGDDCVVKPIDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 3851 - protein, 3291 aa, Artificial Sequence
  derived and/or modified protein sequence (wt) from DENV-2__GQ868552__SS-prME
TAGVIIMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFAIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVLPENLEYTIVITPHSGEEHAVGNDTGKHGKEIKITPQSSITEAELTGYGTVTMECSPRTGLDFNEMVLLQMEEKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEIMDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGIALFLEEMLRTRVGTKHAILLVAISFVTLITGNMSFRDLGRVMVMVGATMTDDIGMGVTYLALLAAFKVRPTFAAGLLLRRLTSKELMMATIGIALLSQSTIPETILELTDALALGMMVLKIVRNMEKYQLAVTIMAISCVPNAVILLNAWKVSCTILAAVSVSPLLLTSSQQKADWIPLALTIKGLNPTAIFLTTLSRTSKKRSWPLNEAVMAVGMVSILASSLLKNDIPMTGPLVAGGLLTVCYVLTGRSADLELERAADVKWEDHAEISGSSPILSITISEDGSMSIKNEEEEQTLTILIRTGLLVISGVFPVSIPITAAAWYLWEVKKQRAGVLWDVPSPPPVEKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGLFKTNTGTIGAVSLDFSPGTSGSPIVDRKGKVVGLYGNGVVTRSGAYVSAIAQTEKSIENNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFRAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGIKNNQILEENVEVEIWTKEGERKKLKPRWLDARIYSDPLALKEFKEFAAGRKSLTLNLITEMGRLPTFMTQKARDALDNLSVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQEPESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMETLQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDRERNLHLEGKCETCVYNMMGKREKKLGEFGKAKGSRAIWYMWLGARFLEFEALGFLNEDHWFSRGNSLSGVEGEGLHRLGYILRDVSKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKSIQHLTVTEEIAVQNWLARVGRERLSRMAISGDDCVVKPLDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 3852 - protein, 3291 aa, Artificial Sequence
  derived and/or modified protein sequence (wt) from DENV-2__GQ868553__SS-prME
TAGVIVMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVQPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEITDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAMVQADSGCVVSWKNKELKCGSGIFITDNVHTWTEQYKFQPESPSKLASAIQKAHEEGICGIRSVTRLENLMWKQVTPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTVGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMATIGIALLSQSTIPETIFELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQILTILIRTGLLVISGVFPVSIPITAAAWYLWEVKKQRAGVLWDVPSPPPVEKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGIFRTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIKAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRKWCFDGIKNNQILEENVEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMETLQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDGRFWELVDRERNLHLEGKCETCVYNMMGKREKKLGEFGKAKGSRAIWYMWLGARFLEFEALGFLNEDHWFSRGNSLSGVEGEGLHRLGYILRDVGKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKSIQHLTATEEIAAQNWLARVGRERLSRMAISGDDCVVKPIDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 3853 - protein, 3291 aa, Artificial Sequence
  derived and/or modified protein sequence (wt) from DENV-2__GQ868554__SS-prME
TAGVIVMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVQPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEITDLEKRHVLGRLITVNPIVIEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVVITWIGMNSRSTSLSVSLVLVGVVTLYLGAMVQADSGCVVSWKNKELKCGSGIFITDNVHTWTEQYKFQPESPSKLASAIQKAHEEGICGIRSVTRLENLMWKQITPELNHILSENEVKLTIMTGDTKGIMQAGKRSLRPQPTELKYSWKTWGKAKMLSTESHNQTFLIDGPETVECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMATIGITLLSQSTIPETILELTDALALGMMVLKIVRNMEKYQLAVTIMAISCVPNAVILRNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVGKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGIFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIKAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRKWCFDGIKNNQILEENVEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASVLLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMETLQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMRITAEWLWKELGKKKTPRMCTREEFTRKVRSNAALGAIFTDENKWKSAREAVEDGRFWELVDRERNLHLEGKCETCVYNMMGKREKKLGEFGKAKGSRAIWYMWLGARFLEFEALGFLNEDHWFSRGNSLSGVEGEGLHRLGYILRDVGKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKSIQHLTATEEIAVQNWLARVGRERLSRMAISGDDCVVKPIDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 3854 - protein, 3291 aa, Artificial Sequence
  derived and/or modified protein sequence (wt) from DENV-2__GQ868555__SS-prME
TAGVIVMLIPTAIAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVQPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEITDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVVITWIGMNSRSTSLSVSLVLVGVVTLYLGAMVQADSGCVVSWKNKELKCGSGIFITDNVHTWTEQYKFQPESPSKLASAIQKAHEEGICGIRSVTRLENLMWKQITPELNHILSENEVKLTIMTGDTKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDLCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLAVTIMAISCVPNAVILRNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAAEVKWEDQAEISGSSPILSITISEDGSMSIKNEEEEQTLTILIRTGLLVISGVFPVSIPITAAAWYLWEVKKQRAGVLWDVPSPPPVGKAELEEGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGIFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIKAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRKWCFDGIKNNQILEENVEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASVLLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMETLQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDGRFWELVDRERNLHLEGKCETCVYNMMGKREKKLGEFGKAKGSRAIWYMWLGARFLEFEALGFLNEDHWFSRGNSLSGVEGEGLHRLGYILRDVSKKEGGAMYADDTAGWDTRITLEDLKNEEMVTNHMKGEHKKLAEAIFKLTYQNKVVRVQRPTPRGTVMDIISRRDQRGSGQVGTYGLNTFTNIEAQLIRQMEGEGIFKSIQHLTATEEIAVQNWLARVGRERLSRMAISGDDCVVKPIDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 3855 - protein, 3291 aa, Artificial Sequence
  derived and/or modified protein sequence (wt) from DENV-2__GQ868556__SS-prME
TAGVIVMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVQPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEITDLEKRHVLGRLITVNPIVIEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVVITWIGMNSRSTSLSVSLVLVGVVTLYLGAMVQADSGCVVSWKNKELKCGSGIFITDNVHTWTEQYKFQPESPSKLASAIQKAHEEGICGIRSVTRLENLMWKQITPELNHILSENEVKLTIMTGDTKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMATIGITLLSQSTIPETILELTDALALGMMVLKIVRNMEKYQLAVTIMAISCVPNAVILRNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVGKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGIFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIKAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRKWCFDGIKNNQILEENVEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASVLLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMETLQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMRITAEWLWKELGKKKTPRMCTREEFTRKVRSNAALGAIFTDENKWKSAREAVEDGRFWELVDRERNLHLEGKCETCVYNMMGKREKKLGEFGKAKGSRAIWYMWLGARFLEFEALGFLNEDHWFSRGNSLSGVEGEGLHRLGYILRDVGKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKSIQHLTATEEIAVQNWLARVGRERLSRMAISGDDCVVKPIDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 3856 - protein, 3291 aa, Artificial Sequence
  derived and/or modified protein sequence (wt) from DENV-2__GQ868557__SS-prME
TAGVIVMLIPTAIAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVQPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEITDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVVITWIGMNSRSTSLSVSLVLVGVVTLYLGAMVQADSGCVVSWKNKELKCGSGIFITDNVHTWTEQYKFQPESPSKLASAIQKAHEEGICGIRSVTRLENLMWKQITPELNHILSENEVKLTIMTGDTKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDLCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLAVTIMAISCVPNAVILRNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAAEVKWEDQAEISGSSPILSITISEDGSMSIKNEEEEQTLTILIRTGLLVISGVFPVSIPITAAAWYLWEVKKQRAGVLWDVPSPPPVGKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGIFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIKAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRKWCFDGIKNNQILEENVEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASVLLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMETLQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDGRFWELVDRERNLHLEGKCETCVYNMMGKREKKLGEFGKAKGSRAIWYMWLGARFLEFEALGFLNEDHWFSRGNSLSGVEGEGLHRLGYILRDVSKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKSIQHLTATEENAVQNWLARVGRERLSRMAISGDDCVVKPIDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 3857 - protein, 3291 aa, Artificial Sequence
  derived and/or modified protein sequence (wt) from DENV-2__GU131947__SS-prME
TAGVIVMLIPTAIAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVQPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEITDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVVITWIGMNSRSTSLSVSLVLVGVVTLYLGAMVQADSGCVVSWKNKELKCGSGIFITDNVHTWTEQYKFQPESPSKLASAIQKAHEEGICGIRSVTRLENLMWKQITPELNHILSENEVKLTIMTGDTKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDLCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLAVTIMAISCVPNAMILRNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAAEVKWEDQAEISGSSPILSITISEDGSMSIKNEEEEQTLTILIRTGLLVISGVFPVSIPITAAAWYLWEVKKQRAGVLWDVPSPPPVGRAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGIFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIKAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRKWCFDGIKNNQILEENVEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASVLLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMETLQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDGRFWELVDRERNLHLEGKCETCVYNMMGKREKKLGEFGKAKGSRAIWYMWLGARFLEFEALGFLNEDHWFSRGNSLSGVEGEGLHRLGYILRDVSKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKSIQHLTAIEEIAVQNWLARVGRERLSRMAISGDDCVVKPIDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 3858 - protein, 3291 aa, Artificial Sequence
  derived and/or modified protein sequence (wt) from DENV-2__GQ868558__SS-prME
TAGVIVMLIPTAIAFHLTTRNGEPHMIVGRQEKGKSLLFKTEDGVNMCTLMAIDLGELCEDTITYKCPLLKQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVQPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEITDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVVITWIGMNSRSTSLSVSLVLVGVVTLYLGAMVQADSGCVVSWKNKELKCGSGIFITDNVHTWTEQYKFQPESPSKLASAIQKAHEEGICGIRSVTRLENLMWKQITPELNHILSENEVKLTIMTGDTKGIMQAGKRSLRPQPTELKYSWKTWGKAKMHSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDLCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLAVTIMAISCVPNAVILRNAWKVSCTILAAVSVSPLLLTSSQQKADWIPLVLTIKGLNPTAIFLTTLSRTSKKRSWPLNEAIMAVGMVSILASSLLKNDIPMTGPLVAGGLLTVCYVLTGRSADLELERAAEVKWEDQAEISGSSPILSITISEDGSMSIKNEEEEQTLTILIRTGLLVISGVFPVSIPITAAAWYLWEVKKQRAGVLWDVPSPPPVGKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGIFKTNAGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIKAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRKWCFDGIKNNQILEENVEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASVLLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMETLQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDGRFWELVDRERNLHLEGKCETCVYNMMGKREKKLGEFGKAKGSRAIWYMWLGARFLEFEALGFLNEDHWFSRGNSLSGVEGEGLHRLGYILRDVSKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKSIQHLTAIEEIAVQNWLAKVGRERLSRMAISGDDCVVKPIDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 3859 - protein, 3291 aa, Artificial Sequence
  derived and/or modified protein sequence (wt) from DENV-2__KJ189305__SS-prME
TAGVIVMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVQPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEITDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLKEKQDVFCDSKLMSAAIKDNRAVHADMGYWIESALNDTWKMEKASFIEVKSCHWPKSHTLWSNGVLESEMIIPKNFAGPASQHNYRPGYYTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVGKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGIFKTNTGTIGAVSLDFSPGTSGSPIVDKKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIKAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRKWCFDGIKNNQILEENVEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNTLGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMETLQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDGRFWELVDRERNLHLEGKCETCVYNMMGKREKKLGEFGKAKGSRAIWYMWLGARFLEFEALGFLNEDHWFSRGNSLSGVEGEGLHRLGYILRDVGKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKSIQHLTATEEIAVQNWLARVGRERLSRMAISGDDCVVKPIDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 3860 - protein, 3291 aa, Artificial Sequence
  derived and/or modified protein sequence (wt) from DENV-2__FJ898451__SS-prME
TAGVIVMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKIVQPENLEYTIVITPHSGEEHAVGNDTGKHGKEIKITPQSSTTEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEITDLEKRHVLGRLITVNPIVTEKDSPVNIEAEPPFGDSYIIVGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGVMVQADSGCIVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFSTNIWLKLREKQDVFCDSKLMSAAIKDNRAVHADMGYWIESVLNDTWKMEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVALSFVTLITGNMSFRDLGRVMVMVGATMTDDIGMGVTYLALLAAFKVRPTFAAGLLLRKLTSKELMMATIGIALLSQSTLPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVGKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGIFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRKWCFDGIKNNQILEENVEVEIWTKEGERKKLKPRWLDARIYSDPLALKEFKEFAAGRKSLTLNLITEMGRLPTFMTQKARNALDNLAVLHTAEVGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGFGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNVGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMETLQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDGRFWELVDRERNLHLEGKCETCVYNMMGKREKKLGEFGKAKGSRAIWYMWLGARFLEFEALGFLNEDHWFSRGNSLSGVEGEGLHRLGYILREVGKKEGGAMYADDTAGWDTRITLEDLKNEEMVTNHMKGEHKKLAEAIFKLTYQNKVVRVQRPTPRGTVMDIISRKDQRGSGQVGTYGLNTFTNMEAQLIRQMEGEGIFKSIQHLTATEEIAVQNWLARVGRERLSRMAISGDDCVVKPIDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 3861 - protein, 3291 aa, Artificial Sequence
  derived and/or modified protein sequence (wt) from DENV-2__HM488257__SS-prME
TAGIIIMMIPTVMAFHLTTRNGEPHMIVSRQEKGKSLLFKTENGVNMCTLMAMDLGELCEDTITYNCPLLRQNEPEDIDCWCNSTSTWVTYGTCTVTGEHRREKRSVALVPHVGMGLETRTETWMSSEGAWKHAQRIETWVLRHPGFTIMAAILAYTIGTTYFQRVLIFILLTAVAPSMTMRCIGISNRDFVEGVSGGSWVDIVLEHGSCVTTMAKNKPTLDFELIKTEAKHPATLRKYCIEAKLTNTTTASRCPTQGEPSLNEEQDKRFVCKHSMVDRGWGNGCGLFGKGGIVTCAMFTCKKNMEGKIVQPENLEYTIVITPHSGEENAVGNDTGKHGKEIKVTPQSSITEAELTGYGTVTMECSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRHVLGRLITVNPIVTEKDSPVNIEAEPPFGDSYIIVGVEPGQLKLSWFKKGSSIGQMFETTMRGAKRMAILGDTAWDFGSLGGVFTSIGKALHQVFGAIYGAAFSGVSWTMKILIGVVITWIGMNSRSTSLSVSLVLVGVVTLYLGVMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKAWGKAKMLSTELHNHTFLIDGPETAECPNTNRAWNSLEVEDYGFGVFTTNIWLKLKERQDVFCDSKLMSAAIKDNRAVHADMGYWIESALNDTWKIEKASFIEVKSCHWPKSHTLWSNGVLESEMIIPKNFAGPVSQHNYRPGYHTQTAGPWHLGRLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTYAAGLLLRKLTSKELMMTTIGIVLLSQSTIPETILELTDALALGMMVLKIVRNMEKYQLAVTIMAILCVPNAVILQNAWKVSCTTLAMVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVRWEEQAEISGSSPILSITISEDGSMSIKNEEEEQTLTILIRTGLLVISGLFPVSIPITAAAWYLWEVKKQRAGVLWDVPSPPPVGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIVDKKGKVVGLYGNGVVTRSGTYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPIRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYIKTRTNDWDFVVTTDISEMGANFKAERVIDPRRCMKPVILTDGEERVILAGPMPVTHSSAAQRRGRVGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGVKNNQILEENVEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDFGLGSITTQQPESNILDIDLRPASAWTLYAVATTFITPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLVLCVTQVLMMRTTWALCEALTLATGPISTLWEGNPGRFWNTTIAVSMANIFRGSYLAGAGLLFSIMKNTANTRRGTGNTGETLGEKWKHRLNALGKSEFQIYKKSGIQEVDRTLAKEGIKRGETDHHAVSRGSAKLRWFVERNLVTPEGKVVDLGCGRGGWSYYCGGLKNVKEVKGLTKGGPGHEEPIPMSTYGWNLVRLQSGVDVFFTPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESETPNLDIIGKRIEKIKQEHETSWHYDQDHPYKTWAYHGSYETKQTGSASSMVNGVVRLLTKPWDVIPMVTQMAMTDTTPFGQQRVFKEKVDTRTQEPKEGTKKLMKITAEWLWKELGKKKTPRMCTREEFTRKVRSNAALGAIFTDENKWKSAREAVEDSGFWELVDKERNLHLEGKCETCVYNMMGKREKKLGEFGKAKGSRAIWYMWLGARFLEFEALGFLNEDHWFSRKNSLSGVEGEGLHKLGYILRDVSKKEGGAMYADDTAGWDTRITLEDLKNEEMVTNHMEGEHKKLAEAIFRLTYQNKVVRVQRPTPRGTVMDIISRRDQRGSGQVVTYGLNTFTNMEAQLIRQMEGEGVFKSIQHLTATEEIAVKTWLVRVGRERLSRMAISGDDCVVKPLDDRFASALTALNDMGKVRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHATHEWMTTEDMLTVWNRVWIQENPWMEDKTPVESWEEIPYLGKREDQWCGSLIGLTSRATWAKNIQTAINQVRSLIGNEEYTDYMPSMKRFRREEEEAGVLW

SEQ ID NO: 3862 - protein, 3291 aa, Artificial Sequence
  derived and/or modified protein sequence (wt) from DENV-2__HQ999999__SS-prME
TAGVIVMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHIQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVQPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEITDLEKRHVLGRLITVNPIVTEKDSPINIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLKEKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDLCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRIGTKHAILLVAVSFVTLITGNMSFRDLGRVMVMVGATMTDDIGMGVTYLALLAAFKVRPTFAAGLLLRKLTSKELMMATIGIALLSQSTIPETILELTDALALGMMVLKVVRNMEKYQLAVTIMAISCVPNAVILQNAWKVSCTILAAVSVSPLLLTSSQQKADWIPLALTIKGLNPTAIFLTTLSRTSTKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVEKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGIFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIKTEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRRWCFDGIKNNQILEENMEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFLTPMLRHSIENSSVNVSLTAIANQATVLMGLGKGWPLSKMDIGAPLLAIGCYSQVNPITLTAALLLLVAHYAIIGPGLQAKATREAQKRAAAGIMKNPTVDGITVIDLDPIPYDPKFEKQLGQVMLLILCVTQVLMMRTTWALCEALTLATGPISTLWEGNPGRFWNTTIAVSMANIFRGSYLAGAGLLFSIMKNTTSTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMEALQRKYGGALVRNPLSRNSTHEMYWVSNATGNIVSSVNMISRMLINRFTMKHKKATYEPDVDLGSGTRNIGIESEVPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDGRFWELVDRERNLHLEGKCETCVYNMMGKREKKLGEFGKAKGSRAIWYMWLGARFLEFEALGFLNEDHWFSRGNSLSGVEGEGLHRLGYILREVSKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKSIQHLTATEEIAVQNWLARVGRERLSRMAISGDDCVVKPIDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 3863 - protein, 3291 aa, Artificial Sequence
  derived and/or modified protein sequence (wt) from DENV-2__FJ898449__SS-prME
TAGMIIMLIPTVMAFHLTTRNGEPHMIVSRQEKGKSLLFKTKDGTNMCTLMAMDLGELCEDTITYKCPFLKQNEPEDIDCWCNSTSTWVTYGTCTTTGEHRREKRSVALVPHVGMGLETRTETWMSSEGAWKHAQRIETWILRHPGFTIMAAILAYTIGTTHFQRVLIFILLTAIAPSMTMRCIGISNRDFVEGVSGGSWVDIVLEHGSCVTTMAKNKPTLDFELIKTEAKQPATLRKYCIEAKLTNTTTDSRCPTQGEPTLNEEQDKRFVCKHSMVDRGWGNGCGLFGKGGIVTCAMFTCKKNMEGKIVQPENLEYTVVITPHSGEEHAVGNDTGKHGKEVKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEIMDLEKRHVLGRLITVNPIVTEKDSPVNIEAEPPFGDSYIIIGVEPGQLKLDWFKKGSSIGQMFETTMRGAKRMAILGDTAWDFGSLGGVFTSIGKALHQVFGAIYGAAFSGVSWTMKILIGVIITWIGMNSRSTSLSVSLVLVGIVTLYLGVMVQADSGCVVSWKNKELKCGSGIFVTDNVHTWTEQYKFQPESPSKLASAIQKAHEEGICGIRSVTRLENLMWKQITSELNHILSENEVKLTIMTGDIKGIMQVGKRSLRPQPTELRYSWKTWGKAKMLSTELHNQTFLIDGPETAECPNTNRAWNSLEVEDYGFGVFTTNIWLRLREKQDVFCDSKLMSAAIKDNRAVHADMGYWIESALNDTWKIEKASFIEVKSCHWPKSHTLWSNGVLESEMIIPKNFAGPVSQHNNRPGYHTQTAGPWHLGKLEMDFDFCEGTTVVVTEECGNRGPSLRTTTASGKLITEWCCRSCTLPPLRYRGEDGCWYGMEIRPLKEKEENLVSSLVTAGHGQIDNFSLGILGMALFLEEMLRTRVGTKHAILLVAVSFVTLITGNMSFRDLGRVMVMVGATMTDDIGMGVTYLALLAAFKVRPTFAAGLLLRKLTSKELMMTTIGIVLLSQSSIPETILELTDALALGMMVLKMVRNMEKYQLAVTIMAILCVPNAVILQNAWKVSCTILAVVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERATDVKWDDQAEISGSSPILSITISEDGSMSIKNEEEEQTLTILIRTGLLVISGLFPVSIPITAAAWYLWEVKKQRAGVLWDVPSPPPVGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFRTNTGTIGAVSLDFSPGTSGSPIVDKKGKVVGLYGNGVVTRSGAYVSAIAQTEKSIEDNPEIEDDIFRKRRLTIMDLHPGAGKTKKYLPAIVREAIKRGLRTLILAPTRVVAAEMEEALRGLPIRYQTPAIRAEHTGREIVDLMCHATFTMRLLSPIRVPNYNLIIMDEAHFTDPASIAARGYISTRVEMGEAAGIFMTATPPGSRDPFPQSNAPIMDEEREIPERSWNSGHEWVTDFKGKTVWFVPSIKTGNDIAACLRKNGKRVIQLSRKTFDSEYVKTRTNDWDFVVTTDISEMGANFKAERVIDPRRCMKPVILTDGEERVILAGPMPVTHSSAAQRRGRIGRNPRNENDQYIYMGEPLENDEDCAHWKEAKMLLDNINTPEGIIPSMFEPEREKVDAIDGEYRLRGEARKTFVDLMRRGDLPVWLAYKVASEGINYADRRWCFDGTRNNQILEENVEVEIWTKEGERKKLKPRWLDARIYSDPLALKEFKEFAAGRKSLTLNLITEMGRLPTFMTQKARDALDNLAVLHTAEAGGKAYNHALSELPETLETLLLLTLLATVTGGIFLFLMSGRGIGKMTLGMCCIITASILLWYAQIQPHWIAASIILEFFLIVLLIPEPEKQRTPQDNQLTYVIIAILTVVAATMANEMGFLEKTKKDLGLGHIATQQPESNILDIDLRPASAWTLYAVATTFITPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLVLCVTQVLMMRTTWALCEALTLATGPVSTLWEGNPGRFWNTTIAVSMANIFRGSYLAGAGLLFSIMKNTTSTRRGTGNIGETLGEKWKSRLNALGKSEFQIYKKSGIQEVDRTLAKEGIKRGETDHHAVSRGSAKLRWFVERNLVTPEGKVVDLGCGRGGWSYYCGGLKNVREVKGLTKGGPGHEEPIPMSTYGWNLVRLQSGVDVFFVPPERCDTLLCDIGESSPNPTVEAGRTLRVLNLVENWLNNNTQFCVKVLNPYMPSVIERMETLQRKYGGALVRNPLSRNSTHEMYWVSNASGNIVSSVNMISRMLINRFTMRHKKATYEPDVDLGSGTRNIGIESETPNLDIIGKRIEKIKQEHEASWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKEKTPRMCTREEFTKKVRSNAALGAIFTDENKWKSAREAVEDNRFWELVDKERNLHLEGKCETCVYNMMGKREKKLGEFGKAKGSRAIWYMWLGARFLEFEALGFLNEDHWFSRENSLSGVEGEGLHKLGYILREVSKKEGGAMYADDTAGWDTRITIEDLKNEEMITNHMAGEHKKLAEAIFKLTYQNKVVRVQRPTPRGTVMDIISRRDQRGSGQVGTYGLNTFTNMEAQLIRQMEGEGIFKSIQHLTASEEIAVQDWLVRVGRERLSRMAISGDDCVVKPLDDRFARALTALNDMGKVRKDIQQWEPSRGWNDWTQVPFCSHHFHELIMKDGRTLVVPCRNQDELIGRARISQGAGWSLRETACLGKSYAQMWSLMYFHRRDLRLAANAICSAVPSHWVPTSRTTWSIHASHEWMTTEDMLTVWNRVWILENPWMEDKTPVESWEEIPYLGKREDQWCGSLIGLTSRATWAKNIQTAINQVRSLIGNEEYTDYMPSMKRFRREEEEAGVLW

SEQ ID NO: 3864 - protein, 3291 aa, Artificial Sequence
  derived and/or modified protein sequence (wt) from DENV-2__FJ906966__SS-prME
TAGMIIMLIPTVMAFHLTTRNGEPHMIVSRQEKGKSLLFKTEDGVNMCTLMAMDLGELCEDTITYKCPFLKQNEPEDIDCWCNSTSTWVTYGTCTTTGEHRREKRSVALVPHVGMGLETRTETWMSSEGAWKHAQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTDSRCPTQGEPSLNEEQDKRFVCKHSMVDRGWGNGCGLFGKGGIVTCAMFTCKKNMEGKVVQPENLEYTIVITPHSGEEHAVGNDTGKHGKEIKITPQSSITEAELTGYGTVTMECSPRTGLDFNEMVLLQMENKAWLVHRQWFLDLPLPWLPGADTQGLNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRHVLGRLITVNPIVTEKDSPVNIEAEPPFGDSYIIIGVEPGQLKLNWFKKGSSIGQMIETTMRGAKRMAILGDTAWDFGSLGGVFTSIGKALHQVFGAIYGAAFSGVSWIMKILIGVIITWIGMNSRSTSLSVSLVLVGVVTLYLGVMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLQPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKIEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMTTIGIVLLSQSTIPETILELTDALALGMMVLKMVRKMEKYQLAVTIMAILCVPNAVILQNAWKVSCTILAVVSVSPLFLTSSQQKADWIPLALTIKGLNPTAIFLTTLSRTNKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGLFPVSIPITAAAWYLWEVKKQRAGVLWDVPSPPPVGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNAGTIGAVSLDFSPGTSGSPIIDKKGKVVGLYGNGVVTRSGAYVSAIAQTEKSIEDNPEIEDDIFRKRKLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWSSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGIKNNQILEENVEVEIWTKEGERKKLKPRWLDARIYSDPLALKEFKEFAAGRKSLTLNLITEMGRLPTFMTQKARDALDNLAVLHTAEAGGRAYNHALSELPETLETLLLLTLLATVTGGIFLFLMSGRGIGKMTLGMCCIITASILLWYAQIQPHWIAASIILEFFLIVLLIPEPEKQRTPQDNQLTYVVIAILTVVAATMANEMGFLEKTKKDLGLGSITTQQPESNILDIDLRPASAWTLYAVATTFVTPMLRHSIENSSVNVSLTAIANQATVLMGLGKGWPLSKMDIGVPLLAIGCYSQVNPITLTAALFLLVAHYAIIGPGLQAKATREAQKRAAAGIMKNPTVDGITVIDLDPIPYDPKFEKQLGQVMLLVLCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTRQEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKSIQHLTVTEEIAVQNWLARVGRERLSRMAISGDDCVVKPLDDRFASALTALNDMGKVRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIQENPWMEDKTPVESWEEIPYLGKREDQWCGSLIGLTSRATWAKNIQTAINQVRSLIGNEEYTDYMPSMKRFRREEEEAGVLW

SEQ ID NO: 3865 - protein, 3291 aa, Artificial Sequence
  derived and/or modified protein sequence (wt) from DENV-2__FJ906968__SS-prME
TAGMIIMLIPTVMAFHLTTRNGEPHMIVSRQEKGKSLLFKTEDGVNMCTLMAMDLGELCEDTITYKCPFLKQNEPEDIDCWCNSTSTWVTYGTCTTTGEHRREKRSVALVPHVGMGLETRTETWMSSEGAWKHAQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTDSRCPTQGEPSLNEEQDKRFVCKHSMVDRGWGNGCGLFGKGGIVTCAMFTCKKNMKGKVVQPENLEYTIVITPHSGEEHAVGNDTGKHGKEIKITPQSSITEAELTGYGTVTMECSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRHVLGRLITVNPIVTEKDSPVNIEAEPPFGDSYIIIGVEPGQLKLNWFKKGSSIGQMIETTMRGAKRMAILGDTAWDFGSLGGVFTSIGKALHQVFGAIYGAAFSGVSWIMKILIGVIITWIGMNSRSTSLSVSLVLVGVVTLYLGVMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLQPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKIEKASFIEVKSCHWPKSHTLWSNEVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMTTIGIVLLSQSTIPETILELTDALALGMMVLKMVRKMEKYQLAVTIMAILCVPNAVILQNAWKVSCTILAVVSVSPLFLTSSQQKADWIPLALTIKGLNPTAIFLTTLSRTNKKRSWPLNEAIMAVGMVSILASSLLKNDIPMTGPLVAGGLLTVCYVLTGRSADLELERAADVKWEDQAEISGSSPILSITISEDGSMSIKNEEEEQILTILIRTGLLVISGLFPVSIPITAAAWCLWEVKKQRAGVLWDVPSPPPVGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNAGTIGAVSLDFSPGTSGSPIIDKKGKVVGLYGNGVVTRSGAYVSAIAQTEKSIEDNPEIEDDIFRKRKLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWSSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGIKNNQILEENVEVEIWTKEGERKKLKPRWLDARIYSDPLALKEFKEFAAGRKSLTLNLITEMGRLPTFMTQKARDALDNLAVLHTAEAGGRAYNHALSELPETLETLLLLTLLATVTGGIFLFLMSGRGIGKMTLGMCCIITASILLWYAQIQPHWIAASIILEFFLIVLLIPEPEKQRTPQDNQLTYVVIAILTVVAATMANEMGFLEKTKKDLGLGSITTQQPESNILDIDLRPASAWTLYAVATTFVTPMLRHSIENSSVNVSLTAIANQATVLMGLGKGWPLSKMDIGVPLLAIGCYSQVNPITLTAALFLLVAHYAIIGPGLQAKATREAQKRAAAGIMKNPTVDGITVIDLDPIPYDPKFEKQLGQVMLLVLCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKSIQHLTVTEEIAVQNWLARVGRERLSRMAISGDDCVVKPLDDRFASALTALNDMGKVRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIQENPWMEDKTPVESWEEIPYLGKREDQWCGSLIGLTSRATWAKNIQTAINQVRSLIGNEEYTDYMPSMKRFRREEEEAGVLW

SEQ ID NO: 3866 - protein, 3291 aa, Artificial Sequence
  derived and/or modified protein sequence (wt) from DENV-2__FJ906969__SS-prME
TAGMIIMLIPTVMAFHLTTRNGEPHMIVSRQEKGKSLLFKTEDGVNMCTLMAMDLGELCEDTITYKCPFLKQNEPEDIDCWCNSTSTWVTYGTCTTTGEHRREKRSVALVPHVGMGLETRTETWMSSEGAWKHAQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTDSRCPTQGEPSLNEEQDKRFVCKHSMVDRGWGNGCGLFGKGGIVTCAMFTCKKNMKGKVVQPENLEYTIVITPHSGEEHAVGNDTGKHGKEIKITPQSSITEAELTGYGTVTMECSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWIMKILIGVIITWIGMNSRSTSLSVSLVLVGVVTLYLGVMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLQPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKIEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMTTIGIVLLSQSTIPETILELTDALALGMMVLKMVRKMEKYQLAVTIMAILCVPNAVILQNAWKVSCTILAVVSVSPLFLTSSQQKADWIPLALTIKGLNPTAIFLTTLSRTNKKRSWPLNEAIMAVGMVSILASSLLKNDIPMTGPLVAGGLLTVCYVLTGRSADLELERAADVKWEDQAEISGSSPILSITISEDGSMSIKNEEEEQILTILIRTGLLVISGLFPVSIPITAAAWCLWEVKKQRAGVLWDVPSPPPVGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNAGTIGAVSLDFSPGTSGSPIIDKKGKVVGLYGNGVVTRSGAYVSAIAQTEKSIEDNPEIEDDIFRKRKLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWSSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGIKNNQILEENVEVEIWTKEGERKKLKPRWLDARIYSDPLALKEFKEFAAGRKSLTLNLITEMGRLPTFMTQKARDALDNLAVLHTAEAGGRAYNHALSELPETLETLLLLTLLATVTGGIFLFLMSGRGIGKMTLGMCCIITASILLWYAQIQPHWIAASIILEFFLIVLLIPEPEKQRTPQDNQLTYVVIAILTVVAATMANEMGFLEKTKKDLGLGSITTQQPESNILDIDLRPASAWTLYAVATTFVTPMLRHSIENSSVNVSLTAIANQATVLMGLGKGWPLSKMDIGVPLLAIGCYSQVNPITLTAALFLLVAHYAIIGPGLQAKATREAQKRAAAGIMKNPTVDGITVIDLDPIPYDPKFEKQLGQVMLLVLCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKSIQHLTVTEEIAVQNWLARVGRERLSRMAISGDDCVVKPLDDRFASALTALNDMGKVRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIQENPWMEDKTPVESWEEIPYLGKREDQWCGSLIGLTSRATWAKNIQTAINQVRSLIGNEEYTDYMPSMKRFRREEEEAGVLW

SEQ ID NO: 3867 - protein, 3291 aa, Artificial Sequence
  derived and/or modified protein sequence (wt) from DENV-2__FJ898454__SS-prME
TAGVIIMLIPTAMAFHLTTRNGEPHMIVSRQEKGKSLLFKTEDGVNMCTLMAMDLGELCEDTITYNCPLLRQNEPEDIDCWCNSTSTWVTYGTCTATGEHRREKRSVALVPHVGMGLETRTETWMSSEGAWKHAQRIETWILRHPGFTIMAAILAYTIGTTYFQRVLIFILLTAVAPSMTMRCIGISNRDFVEGVSGGSWVDIVLEHGSCVTTMAKNKPTLDFELIKTEAKQPATLRKYCIEAKLTNTTTASRCPTQGEPSLNEEQDKRFVCKHSMVDRGWGNGCGLFGKGGIVTCAMFTCKKNMEGKIVQPENLEYTIVVTPHSGEENAVGNDTGKHGKEIKVTPQSSITEAELTGYGTVTMECSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVVRVQYEGDGSPCKIPFEIMDLEKRHVLGRLITVNPIVTEKDSPVNIEAEPPFGDSYIIIGVEPGQLKLSWFKKGSSIGQMFETTMRGAKRMAILGDTAWDFGSLGGVFTSIGKALHQVFGAIYGAAFSGVSWTMKILIGVVITWIGMNSRSTSLSVSLVLVGVVTLYLGVMVQADSGCVVSWKNKELKCGSGIFITDNVHTWTEQYKFQPESPSKLASAIQKAYEEGICGIRSVTRLENLMWKQITPELNHILSENEAKLTIMTGDIKGIMQAGKRSLRPQPTELKYSWKTWGKAKMLSTEPHNQTFLIDGPETAECPNTNRAWNSLEVEDYGFGVFTTNIWLKLKERQDVFCDSKLMSAAIKNNRAVHADMGYWIESALNDTWKIEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAVLLVAVSFMTLITGNMSFRDLGRVMVMVGAAITDDIGMGVTYLALLAAFKVRPTFAAGLLLRKLTSKELMMTTIGIVLLSQSTIPETILELTDALALGMMILKIVRNMEKYQLAVTIMATLCVPNAVILQNAWKVSCTILAVVSVSPLLLTSSQQKADWIPLALTIKGLNPTAIFLTTLSRTNKKRSWPLNEAIMAVGMVSILASSLLKNDIPMTGPLVAGGLLTVCYVLTGRSADLELERAADVRWEDQAEISGSSPILSITISEDGSMSIKNEEEEQTLTILIRTGLLVISGLFPVSIPITAAAWYLWEVKKQRAGVLWDVPSPPPVGKAELEDGAYRIKQKGILGYSQIGAGVYKEGTFHTMWHVTRGAVLMHKGKRIEPSWADVRKDLISYGGGWKLEGEWKEGEEVQVLALEPGKNPRAVQTKPGLFKTNTGTIGAVSLDFSPGTSGSPIVDKKGKVVGLYGNGVVTRSGTYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYIKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGIKNNQILEENVEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKRDFGLGSIATQQPESNILDIDLRPASAWTLYAVATTFITPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLVLCVTQVLMMRTTWALCEALTLATGPISTLWEGNPGRFWNTTIAVSMANIFRGSYLAGAGLLFSIMKNTTNTRRGTGNTGETLGEKWKNRLNSLGKSEFQIYKRSGIQEVDRTLAKEGIKRGETDHHAVSRGSAKLRWFVERNLVTPEGKVVDLGCGRGGWSYYCGGLKNVREVKGLTKGGPGHEEPIPMSTYGWNLVRLQSGVDVFFTPPEKCDTLLCDIGESSPNPTVEAGRTLRVLNLVENWLNNNTQFCIKVLNPYMPSVIEKMETLQRKYGGALVRNPLSRNSTHEMYWVSNASGNIVSSVNMISRMLINRFTMRHKKATYEPDVDLGSGTRNIGIESETPNLDIIGKRIEKIKQEHETSWHYDQDHPYKTWAYHGSYETKQTGSASSMVNGVVRLLTKPWDVIPMVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKIGEFGKAKGSRAIWYMWLGARFLEFEALGFLNEDHWFSRENSLSGVEGEGLHKLGYILREVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMGAQLIRQMEGEGVFKGIQHLTATEEVAVQDWLARVGRERLSRMAISGDDCVVKPLDDRFASALTALNDMGKIRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHARHEWMTTEDMLTVWNRVWIQENPWMEDKTPVESWEEIPYLGKREDQWCGSLIGLTSRATWAKNIQTAINQVRSLIGSEEYTDYMPSMKRFRREEEEAGVLW

SEQ ID NO: 3868 - protein, 3291 aa, Artificial Sequence
  derived and/or modified protein sequence (wt) from DENV-2__JQ922551__SS-prME
TVGMIIMLIPTAMAFHLTTRNGEPHMIVSRQEKGKSLLFKTEDGVNMCTLMAMDLGELCEDTITYNCPLLKQNEPEDIDCWCNSTSTWVTYGTCTATGEHRREKRSVALVPHVGMGLETRTETWMSSEGACKHAQRIETWILRHPSFTIMAAILAYTIGTTYFQRVVFLMVLTAVALSMTMRCIGISNRDFVEGVSGGSWVDIVLEHGSCVTTMAKNKPTLDFELIKTEAKQPATLRKYCIEAKLTNTTTASRCPTQGEPSLNEEQDKRFVRKHSMVDRGWGNGCGLFGKGGIVTCAMFTCKKNMEGKIVQPENLEYTLVITPHSGEENAVGNDTGNHGKEIKVTPQSSITEAALTGYGTVTMECSPRTGLNFHEMVSLPMENKAWMVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVWGIARTQHGTIVHRVQYEGDGSPCKIPLNIMGLEKRHVLGRPITVNPIVTGKDSPVNIEAEPPLGDSYIIIGVEPGQVKLTCSQKGSSIGQMFETTMRGAKRMAILGDTAWDFGSLGGVFTSIGKALHQVFGAIYGAAFSGVSWTMKILIGVVITWIGMNSRSTSLSVSLVLVGVVTLYLGVMVQADSGCVVSWKNKELKCGSGIFVTDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTEPHNQTFLIDGPETAECPSTNRAWNSLKGGDYGFGVFTTNIWLKLKERQDVSCDSKLMSAAIKDNRAVHADMGYWIESALNDTWKIEKASFIEVKSCHWPKSHTLWSNGVLESEMIIPKNLAGPVSQHNYRPGYHTQTAGPWHLGKLEMDFDLCEGTTVVVTEDCGNRGPSLRTTTASGKLITEWCCRSCTLPPLRYRGEDGCWYGMEIRPLKEKEENLVNSLVTAEHEQIDNFSLGVLGMALFLEEMLRTRVGTKHAVLLVAVSFMTLITGNMSFRDLGRVMVMVGAAMTDDIGMGVTYLALLAAFKVRPTFAAGLLLRKLTSKELMMTTIGIVLLSQSTIPETILELTDALALGMMILKIVRNMEKYQLAVTIMAILCVPNAMILQNAWKVSCTILAVVSVSPLLLTSSQQKADWIPLALTIKGLNPTAIFLTTLSRTNKKRSWPLNEAIMAVGMVSILASSLLKNDIPMTGPLVAGGLLTVCYLLPGRSADLELERAADLRWEDQAEISGSSPILSITISEDGSMSIKNQEEKQTLTILIKTGLLVISELFPVQIPITAAAWYLWEVKKQRAGVLWDVPSPPPVGKAELEDGAYGIKQKGILGYSQIGAGVYKEGTFHTMWHVTRGAVLMHKGKRIEPSWADVRKDLISYGGGWKLEGEWKEGEEVQVLALEPGKNPRAVQTRPGLFKTNTGTIGAVSLDFSPGTSGSPIVDKKGKVVGLYGNGVVTRSGTYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYIKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGIKNNQILEENVEVEIWTKEGEKKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTAVAATMANEMGFLEKTKKDFGLGSIATQPPESNILDIDLRPASAWTLYAVATTFITSMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLVLCVTQVLMMRTTWALCEALTLATGPISTLWEGNPGRFWNTTIAVSMANIFRGSYLAGAGLLFSIMKNTTNTRRGTGNTGETLGEKWKNRLNALGKSEFQIYKKSGIQEVDRTLAKEGIKRGETDHHAVSRGSAKLRWFVERNLVTPEGKVVDLGCGRGGWSYYCGGLKNVREVKGLTKGGPGHEEPIPMSTYGWNLVRLQSGVDVFFTPPEKCDTLLCDIGESSPNPTVEAGRTLRVLNLVENWLNNNTQFCVKVLNPYMPSVIEKMETLQRKYGGALVRNPLSRNSTHEMYWVSNASGNIVSSVNMISRMLINRFTMRHKKATYEPDVDLGSGTRNIGIESETPNLDIIGKRIEKIKQEHETSWHYDQDHPYKTWAYHGSYETKQTGSASSMVNGVVRLLTKPWDVIPMVTQMAMTDTTPFGQQRVFKEKSDTRTQEPKEGTKKLMKITPKWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMGANHLEGEPKKLYEAIFKLTYQNKGVRVQRPTPRGPLMDIILRRDQGGSGQVGTYGLNTFTNMGAQLIRQMEGEGVFKGIQHLIATEEIAVQDWLARVGRERFSRMAISGDDCVVKPLDDRFASALTALNDMGKERKVLQQWEPSREWNDWTQVPFCSHHFHELIMKDGRVLVVPCRNQDELIGRARISQGAGWSLRETACLGKSYAQMWSQMYFHRRDLRLAANAICSAVPSHWVPTSRTTWSIHARHEWMTTEDMLTVWNRVWIQENPWMEDKTPVESWEEIPYLGKREDQWCGSLIGLTSRATWAKNIQTAINQVRSLIGNEEYTDYMPSMKRFRREEEEAGVLW

SEQ ID NO: 3869 - protein, 3291 aa, Artificial Sequence
  derived and/or modified protein sequence (wt) from DENV-2__JQ922550__SS-prME
TVGMIIMLIPTVMASHLTTRNGGPHMIVIGQQKRKTSFFKTKKGHDMCTLMAMAFGEFCENTITYKCPFLKQNEPEDIDCWCNSTSTWVTYGTCTTTGEHRREKRSVALVPHVGMGLETRTETWMSSEGAWKHAQRIETWILRHPGFTIMAAILAYTIGTTHFQRVLIFILLTAIAPSMTMRCIGISNRDFVEGVSGGSWVDIVLEHGSCVTTMAKNKPTLDFELIKTEAKQPATLRKYCIEAKLTNTTTDSRCPTQGEPTLNEEQDKRFVCKHSMVDRGWGNGCGLFGKGGIVTCAMFTCKKNMKGKIVQPENLEYTVVITPHSGEEHAVGNDTGKHGKEVKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIKDLEKRHVLGRLITVNPIVTEKDSPVNIEAEPPLGDSYIIIGVEPGQLKLDWFKKGSSIGQMFENTMRGAKRMAILGDTAWDFGSLGGVFTSIGKALHQVFGAIYGAAFSGVSWTMKILIGVIITWIGMNSRSTSLSVSLVLVGIVTLYLGVMVQADSGCGGCERKTKTKCGSGIFVTDNVHTWTEQYKFQPESPSKLASAIQKAHEEGICGIRSVTRLENLMWKQITPELNHILSENEVKLTIMTGDIKGIMQAGKRSLRPQPTELRYSWKTWGKAKMLSTELHNQTFLIDGPETAECPNTNRAWNSLEVEDYGFGVFTTNIWLRLREKQDVFCDSKLMSAAIKDNRAVHADMGYWIESALNDTWKIEKASFIEVKSCHWPKSHTLWGNGVLESEMVIPKNFAGPVSQHNNRPGYYTQTAGPWHLGKLEMDFDFCEGTTVVVTEDCGNRGPSLRTTTASGKLITEWCCRSCTLPPPKYRGEDGCWYGMEIRPLKEKEENLVSSLVTAGHGQIDNFSLGILGMALFLEEMLRTRVGTKHAILLVAVSFVTLITGNMSFRDLGRVMVMVGATMTDDIGMGVTYLALLAAFKVRPTFAAGLLLRKLTSKELMMTTIGIVLSSQSSIPETILELTDALALGMMVLKMVRNMEKYQLAVTIMAILCVPNAVILQNAWKVSCTILAVVSVSPLLLTSSQQKADWIPLALTIKGLNPTAIFLTTLSGTSKRRSWPLNEAIMAVGMVSILASSLLKNDIPMTGPLVAGGLLTVCYVLTGRSADLELERATDVKWDDQAEISGSSPILSITISEDGSMSIKNEEEEQTLTILIRTGLLVISGLFPVSIPITAAAWYLWEVKKQRAGVLWDVPSPPLVGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFRTNTGTIGAVSLDFSPGTSGSPIVDKKGKVVGLYGNGVVTRSGAYVSAIAQTEKSIEDNPEIEDDIFRKRRLTIMDLHPGAGKTKRYLPAIVREAIKRGLRTLILAPTRVVAAEMEEALRGLPIRYQTPAIRAEHTGREIVDLMCHATFTMRLLSPIRVPNYNLIIMDEAHFTDPASIAARGYISTRVEMGEAAGIFMTATPPGSRDPFPQSNAPIMDEEREIPERSWNSGHEWVTDFKGKTVWFVPSIKTGNDIAACLRKNGKRVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTLLELIRGGPIPVYLGYKWPGEGINYADSRLCVGRTQNNQILEENVEVEIWTKEGKGKKLKPRWLDARIYSDPLALKEFKEFAAGRKSLTLNLITEMGRLPTFMTQKARDALDNLAVLHTAEAGGKAYNHALSELPETLETLLLLTLLATVTGGIFLFLMSGRGIGKMTLGMCCIITASILLWYAQIQPHWIAASIILEFFLIVLLIPEPEKQRTPQDNQLTYVIIAILTVVAATMANEMGFLEKTKKDLGLGNIATQQPESNILDIDLRPASAWTLYAVATTFITPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLVLCVTQVLMMRTTWALCEALTLATGPVSTLWEGNPGRFWNTTILIQMANILRGSYLAGAGPLFSIMENTTGPRRRTGQLGRELLRRWKSRLNALGKSEFQIYKKSGIQEVDRTLAKEGIKRGETDHHAVSRGSAKLRWFVERNLVTPEGKVVDLGCGRGGWSYYCGGLKNVREVKGLTKGGPGHEEPIPMSTYGWNLVRLQSGVDVFFIPPERCDTLLCDIGESSPNPTVEAGRTLRVLNLVENWLNNNTQFCIKVLNPYMPSVIEKMETLQRKYGGALVRNPLSRNSTHEMYWVSNASGNIVSSVNMISRMLINRFTMRHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRIQEPKEGTKKLMKIMAEWLWKELGKKKTPRMCTREEFTKKVRSNAALGAIFTDENKWKSAREAVEDGRFWELVDRERNLHLEGKCETCVYNMMGKREKKLGEFGKAKGSRAIWYMWLGARFLEFEALGFLNEDHWFSRENSLSGVEGEGLHKLGYILREVSKKEGGAMYADDTAGWDTRITLGALKNERKCTEHMEGEPRKPGRGHFKWRNQNRVVGVQGPTPGGTVMDIISRKNQRGSGQVGTYGLNTFTNMEAQLIRQMEGEGFFIEHQHLTASEENAVQDWLARVGREKVSRMPISGDDCVVKPLDDRFARALTALNDMGKVRKDIQQWEPSRGWNDWTQVPFCSHHFHELIMKDGRTLVVPCRNQDELIGRARISQGAGWSFGETACLGKSYAQMWSLINFRIPDLRLAANVICSVVPSHWVPTSRTTWSIHANHEWMTTEDMLTVWNRVWILENPWMEDKTPVESWEEIPYLEKREDQWCGSLIGLTPQPPWAKNIETAINQVRSLIGNEEYIDYLPSMKRFRIEEEESGFLW

SEQ ID NO: 3870 - protein, 3291 aa, Artificial Sequence
  derived and/or modified protein sequence (wt) from DENV-2__JQ922553__SS-prME
TAGMIIMLIPTVMAFHLTTRNVEPPMIFSRQEKGKSFLFKTKDGHDMCTFMAMDLGELCEDTITYKCPFLKQNEPEDIDCWCNSTSTWVTYGTCTTTGEHRREKRSVALVPHVGMGLETRTETWMSSEGAWKHVQRIETWILRHPGFTIMAAILAYTIGTTHFQRVLIFILLTGVAPSMRMRCIGISNRDFVEGVSGGSWVDIVLEHGSCVTTMAKNKPTLDLELIKTEAKQPATLRKYCIEAKLTNTTTDSRCPTQGEPTLNEEQDKRFVCKHSMVDRGWGNGCGLFGKGAIVTCAMFTCKKSMKGKIVQPENLEYTVVITPHSGEEYAVGNDTGKHGKEVKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRHVLGRLITVNPIVTEKDSPVNIEAEPPFGDSYIIIGVEPGQLKLDWFKKGSSIGQMLETTMRGAKRMAILGDTAWDFGSLGGVFTSIGKALHQVFGAIYGAAFSGVSWTMKILIGVIITWIGMNSRSTSLSVSLVLVGIVTLYLGVMVQADSGCVVSWKNKELKCGSGIFVTDNVHTWTEQYKFQPESPSKLASAIQKAHEEGICGIRSVTRLENLMWKQITLELNHILSENEVKLTIMTGDIKGIMQVGKRSLRPQPTELRYSWKTWGKAKMLSTELHNQTFLIDGPETAECPNANRAWNSLEVEDYGFRKYKTKIWPTLKEWRKVFCDSKLMSAAIKDNRAVHADMGYWIESALNDTWKIEKASFIEVKSCHWPKSHTLWGNGVQESEMVIPKNFAGPVSQHNNRPGYYTQTAGPWHLGKLEMDFDFCEGTTVVVTEDCGNRGPSLRTTTASGKLITEWCCRSCTLPPLRYRGEAGCWYWMDIRPLKEKEKNLVSSLVTAGHGQIDNFSLRILGMALFLEKMLMTRLGTKHAILLVAVSFVTLITRNMSFKDLGRVMVMVGATMTDDMRMGVTYLALLPAFKVRPTFATGLLLRKLTSKELMMTTIGIVLFSQSSIPETILELTDALALGMMVLKMVRNMEKYQLAVTIMAILCVPNAVILQNAWRVSCTILAVVSVSPLFLTSSRQKADWIPLALTIKGLNPTAIFLTTLSRTSKKRSWPLNEAIMAVGMVSILASSLLKNDIPMTGPLVAGGLLTVCYVLTGRSADLELERAADVKWDDQAEISGSSPILSITISEDGSMSIKNEEEEQTLTILIRTGLLVISGLFPVSIPITAAAWYLWEVKKQRAGVLWDVPSPPPVGKAELEDGAYRIQQKGIFGYSQIGAGVYKEGTFPTMWHVTRGAVLMHKGKRIEPSWADVKKDLISYGGGWKLEGEWKEGEEVQVLALEPGKNPRAVQTKPGLFKTNTGTIGAVSLDFSPGTSGSPIVDKKGKVVGLYGNGVVTRSGAYVSAIAQTEKSIEDYPEVEMDIFRKKRLTIMDFHPGAGRQKRYFPAIVREAIKRGLRTLILAPTRVVAAEMEEALRGLPIRYQTPAIRAEHTGREIVDLMCHATFTMRLLSPIRVPNYNLIIMDEAHFTDPASIAARGYISTRVEMGEAAGIFMTATPPGSRDPFPQSNAPIMDEEREIPERSWNSGHEWVTDFKGKIVWFVPSLKTGKYIAACLRKNGKRVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTLLELIRGGPIPVYLGYKWPGEGINYADSRLCFDGIKNNQILEENVEVEIWTKEGERKELKPRWLDARIYSDPLALKEFKEFAAGRKSLTLNLITEMGRLPTFMTQKARGALASLMVLHTAEAGGRAYNHALSELPETLETLLLLTLLATVTGGIFLFLMSGRGIGKMTLGMCCIITASILLWYAQIQPHWIAASIILEFFLTVLLIPEPEKQRTPQDNQLTYVIIAILTVVAATMANEMGFLEKTKKDLGLGNIATQQSCKKILDIYLGPALPWKLYAGGTTFITPMLRHSIENSSVNVSLTAIANQATVLMGLGKGWPLSKMDIGVPLLAIGCYSQVNPITLTAALFLLVAHYAIIGPGLQAKPTREAQKRAAAGIMKNPTVDGITVIDLDPIPYDPKFEKQLGQVMLLVLCVTQVLMMRTTWALCEALTLATGPVSTLWEGNPGRFWNTTIAVSMANIFRGSYLAGAGLLFSIMKNTTSTRRGTGNIGETLGEKWKSRLNALGKSEFQIYKKSGIQEVDRTLAKEGIKRGETDHHAVSRGSAKLRWFDERNLVTPEGKVVDLGCGRGGWSFFCGGLKNVREVKALTIGGPGHEEPILMSTYGRNLVRSQSGVVVFHTPPEKCDTSLRDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESETPNLDIIGKRIEKIKQEHETSWHYDQDHPYKTWGSHGSYETKQTGSASSMVNGVVRLLTKPWDVVPMVTQMAMTDTTPFGQQRVFKEKVDTRTQEPKEGTKKLMKITAEWLWKELGKKKTPRMCTREEFIKKVRSNAALGAIFTDENKWKSAREAVEDGRFWELVDKERNLHLEGKCETCVYNMMGKREKKLGEFGKAKGSRAIWYMWLGARFLEFEALGFLNEDHWFSRENSLSGVEGEGLHKLGYILREVSKKEGGAMYADDTAGWDTRITLEDLKNEERKTNHMGGEHRKLARGIFKMNLTNKVVRVQRPTPGGTLMDIISRKTQRGSEQVGTYGLTTLTNLEAPPIRQMEGKGVFKGHQHRTASEENAVQDWLARVGGERLSRLAISGDDCVVKPLDDRFARALTALNDMGKVRKDIQQWEPSRGWNDWTQVPFCSHHFHELIMKDGRTLVVPCRNQDELIGRARISQGAGWSLRETACLGKFYAQRWSLMYFHRRDLRLAPNAICSAVRTHWVPTSRKTWPIHASHDWMTTEVMLTVWNKLWFQENPWMEDKTPVGFWEEIPFLEKGKDQWGGSLIGLTSRPPWAKNFQPAINQVRSLLCNEESADFMPSMKRFRREEEEAGVLW

SEQ ID NO: 3871 - protein, 3291 aa, Artificial Sequence
  derived and/or modified protein sequence (wt) from DENV-2__JQ922549__SS-prME
TAGVIIMLIPTAMAFHLTTRNGEPHMIVSRQEKGKSLLFKTEDGVNMCTLMAMDLGELCEDTITYNCPLLRQNEPEDIDCWCNSTSTWVTYGTCTAPGDHRREKRSVALVPHVGMGLETRTETWMSSEGAWKHAQRIETWILRHPGFTIMAAILAYTIGTTYFQRVLILILLTAVAPSMTMRCIGISNRDFVEGVSGGSWVDIVLEHGSCVTTMAKNKPTLDFELIKTEAKQPATLTKYCIEAKLTNTTTASRCPTQGEPSLNEEQHKRFVCKHSMVDRGWGNGCGLFGKGGIVTCAMFTCKKNMKGKIVQPENLEYTIVVTPHSGEENAVGNDTGKHGKEIKVRPQSSITEAELTGYGTVTMECSPRTGFAFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRLVLGRLITVNPIVTEKDSPVNIEAEPPFGDSYIIIGVEPGQLKPSWFKKGSSIRQMFETTMRGAKRMAILGDTAWDFGSLGGVFTSIGKALHQVFGAIYGAAFSGVSWTMKILIGVVITWIGTNSRSTSLSVSLVLVGVVTLYLGVMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTEPHNQTFLIGGPETAECPNTNRAWNSLEVEDYGFGVFTTNIWLKLKERQDVFCDSKLMSAAIKDNRAVHADMGYWIESALNDTWKIEKASFIEVKSCHWPKSHTLWSNGVLESEMIIPKNFAGPVSQHNYRPGYHTQTAGPWHLGKLEMDFHFCEGTTVVVTEDCGNRGPSLRTTTASGKLITEWCCRSCTLPPLRYRGEDGCWYGMEIRPLEGEEGDLVHSLVTAGHGQIDNFSLGVLGMALFLEEMLRTRVGTKHAVLLVAVSFMTLITGNMSFRDLGRVMVMVGAAMTDDIGMGVTYLALLAAFKVRPTFAAGLLLRKLTSKELMMTTIGIVLLSQSTIPETILELTDALALGRMILKIVRNMEKYQLAVTIMAILCVPNAVILQNAWKVSCTILAVVSVSPLLLTSSQQKADWIPLALTIKGLNPTAIFLTTLSRTNKKRSWPLNEAIMAVGMVSILASSLLENDIPMTGPLVAGGLLTVCYVLTGRSADLELERAADVRWEDQAEISGSSPILSITISEDGSMSIKYEEEEPTLTILIRTGLLVISGLFPVSIPITAAAWYLWEVKKQRAGVLWDVPSPPPVGKAELEDGAYRIKQKGILGSSQIGARVYKEGTFHTMWHVTRGAVLMHKGKRIEPSWADVRKDLISYGGGWKLEGEWKEGEEVQVLALEPGKNPRAVQTKPGLFKTNTGTIGTVSLDFSPGTSESPIVDKKGKVVGLYGNGVVTRSGTYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYIKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGIKNNQILEENVEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDFGLGSIATQQPESNILDIDLRPASAWTLYAVATTFITPMLRHSIENSPVNVSLTAIANQATVLMGLGKGWPLSKMDIGVPPLAIGCYSQVNPITLTAALLLLVAHYAIIGPGLQVKATREAQKRAAAGIMKNPTVDGITVIDLDPIPYDPKFEKQLGQIMLRVLCVTQVLMMRTTWALCEALTLATGPISTLWEGNPGRLGNTTIAVSMANIFRGSYLAGAGLLFSIMKNTTNTRRGTSNLGETLGEKWKNRLNSLGKSEFQIYKKSGIQEVDRTLAKEGIKKGETDHHAVSRGSAKLRWFVERNLVTPEGKVVDLGCGRGGWSYYCGGLKNVREVKGLTKGGPGHEEPIPMSTYGWNLVRLQSGEDVFFTPPEKCDTLLCDIGESSPNPTVEAGRTLRVLNMVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESETPNLDIIGKRIEKIKQEHETSWHYDQDHPYKTWAYHGSYETKQTGSASSLVNGVVRLLTKPWDVIPMVTQMAMTDTTPFGQQRVFKEKVDTRTQEPKEGTKKLMKITAEWLWKELGKKKTPRMCTREEFSRKVRSNAALGAIFTDENKWKSAREAVEDGRFWELVDKERILHLEGKCETCVYNMMGKREKKIGEFGKAKGSRAIWYMWLGARFLEFEALGFLNEDHWFSRENSLSGVEGEGLHKLGYILREVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMGAQLIRQMEGEGVFKGIQHLTATEEIAVQDWLARVGRERLSRMAISGDDCVVKPLDDRFASALTALNDMGKVRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWVPTSRTTRSIHARQEWMTTEVMLTVWNRVWIQENPWMEDKTPVESWEEIPYLGKREDQWCGSLIGLTSRATWAKNIQTAINQVRSLIGSEEYTDYMPSMKRFRREEEEAGVLW

SEQ ID NO: 3872 - protein, 3291 aa, Artificial Sequence
  derived and/or modified protein sequence (wt) from DENV-2__JQ922552__SS-prME
TAGMIIMLIPTVMAFHLTTRNGEPPMIVSRQEKGKSLLFKTEDGVNMCALMAMDLGERCEDTITYNCPLLNQNEPEDIDCWCNSTSTWVTYGTCTTTGELRREKISVALVPHVGMGLETRTETWMSSEGAWKHAQRIEIWILRHPGFTIMAAILAYTIGTSHFQRVLIFILLTAIAPSMTMRCIGISNRDFVEGVSGGSWVDIVLEHGSCVTTMAKNKPTLDFELIKTEAKQPATLRKYCIEAKLTNTTTDSRCPTQGEPTLNEEQDKRFVCKHSMVDRGWGNGCGLFGKGGIVTCAMFTCKKIMKGKIVQPENLEYTVVITPHSGEEHAVGNDTGKHGKEVKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRHVLGRLITVNPIVTEKDSPVNIEAEPPFGDSYIIIGVEPGQLKLNWFKKGSSIGQMLETTMRGAKRMAILGDTAWDFGSLGGVFTSIGKALHQVFGAIYGAAFSGVSWTMKILTGVIITWIGMNSRSTSLSVSLVLVGIVTLYLGVMVQADSGCVVSWKNKELKCGSGIFVTDNVHTWTEQYMFQPESPSKLASAIQKAHEEGICGIRSVTRLENLMWKQITPELNHILSENEVKLTIMTGDIKGIMQVGKRSLRPQPTELRYSWKTWGQPKMLSPELHHQTFLIDGPETAECPNTNRTWDSLEVEDYGFGVFTTKIWLRLREKQDVFCDSKLMSAAIKDNRAVHADMGYWIESALNDTWKIEKASFIEVKSCHWPKSHTLWSMGVLESEMVIPKNFAGPVSQHNHRPGIPTQTAGPWHLGKLEMDFDFCEGTTVVVTEDCGNRGPSLRTSTASGKLITEWCCRSCTLPPLRYRGEDGCWYGMEIRPLKEKEENLVSSLVTAGHGQIDNFSLGILGMALFLEEMLRTRVGTKHAILLVAVSFVTLITGNMSGRDLGRVMVMVGATMTDDIGMGVTYLALLAAFKVRPTFAAGLLLRKLTSKELMMTTIGIVLLSQSSIPETILELTDALALGMMVLKMVRNMEKYQLAVTIMAILCVPNAVILQNAWKVSCTILALVSVSPLFLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWDDQAEISGSSPILSITISEDGSMSIKNEEEEQTLTILIRTELLVISGLFPISIPITAAAWYLWEVKKQRAGVLWDVPSPPPVGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIVDKKGKVVGLYGNGVVTRSGAYVSAIAQTEKSIEDNPEIEDDIFRRKKLTIMDLHPGAGKTKRYLPAIVREAIKRGLRTLILAPTRVVAAEMEEALRGLPIRYQTPAIRAEHTGREIVDLMCHATFTMRLLSPIRVPNYNLIIMDEAHFTDPASIAARGYISTRVEMGEAAGIFMTATPPGSRDPFPQSNAPIMDEEREIPERSWNSGHEWVTDFKGKTVWFVPSIKTGNDIAACLRKNGKRVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRGPAEGINYADRRWCFDGIKNSQFLEENVEVEIWPSGGERKELKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGRGIGKMTLGMCCIITASILLWYAQIQPHWIAASIILEFFLIVLLIPEPEKQRTPQDNQLTYVIIAILTVVAATMANEMGFLEKTKKDLGLGNIVTQQPESNILDIDLRPASAWTLYAAATTFITPMLRHSIENSSVNMSLTAIANQATVLMGLGKGWPLSKMDIGVPLLAIGCYSQVNPITLTAALFLLVAHYAIKGPGLQAKATREAQKRAAAGIMKNPTVDGITVIDLDPIPYDPKFEKQLGQVMLLVLCVTQVLMMRTTWALCEALTLATGPVSTLWEGNPGRFWNTTIAVSMANIFRGSYLAGSSQVWPSINNLKGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFTPPEKCDTLLCDIGESSPNPTVEAGRTLRVLNLVENWLNNNTQFCIKVLNPYMPSVIEKMETLQRKYGGALVRNPLSRNSTHEMYWVSNASGNIVSSVNMISRMLINRFTMRHKKATYEPDVDLGSGTRNIGIESETPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCPREEFTKKVRSNAALGAIFTDATKWKSAREAVEDGRFWELVDKERNLHLEGKCETCVYNMMGKREKKLGEFGKAKGSRAIWYMWLGARFLEFEALGFLNEDHWFSRENSLSGVEGEGLHKLGYILREVRKKEGGAMYADDSAGWDTRITLEDLKNEERITNHMEVEHKKLAVGHFILTYPNKVVRVQRPTPVGTVMDIISRKSQRGSGQVGTYGLNTFTNLEGPRIRQMEGEESFKSHQLQTATERNAVQDWLARVGRERLSRMAISGDDCVVKPLDDRFARALTALNDMGKVRKDIQQWEPSRGWNDWTQVPFCSHHFHELIMKDGRTLVVPCRNQDELIGRARISQGAGWSLRETACLGKSYAQMWSLMYFHRRDLRLAANAICSAVPSHWVPTSRTTWSIHASHEWVATEDMLTVWNRVWIQENPWMEDKTPVESWEEIPYLGKREDQWCGSLIGLTSRATWAKNIQTAINQVRSLIGNEEYTDYMPSMKRFRREEEEAGVLW

SEQ ID NO: 3873 - protein, 3291 aa, Artificial Sequence
  derived and/or modified protein sequence (wt) from DENV-2__GU131896__SS-prME
SAGMIIMLIPTVMAFHLTTRNGEPHMIVGIQEKGKSLLFKTEDGVNMCTLMAMDLGELCEDTITYKCPLLRQNEPEDIDCWCNSTSTWVTYGTCTTTGEHRREKRSVALVPHVGMGLETRTETWMSSEGAWKHAQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLKEEQDKRFVCKHSMVDRGWGNGCGLFGKGGIVTCAMFTCKKNMEGKIVQPENLEYTIVVTPHSGEEHAVGNDTGKHGKEIKVTPQSSITEAELTGYGTVTMECSPRTGLDFNEMVLLQMENKAWLVHRQWFLDLPLPWLPGADKQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRLQYEGDGSPCKIPFEIMDLEKRYVLGRLITVNPIVTEKDSPVNIEAEPPFGDSYIIIGVEPGQLKLNWFKKGSSIGQMFETTMRGAKRMAILGDTAWDFGSLGGVFTSVGKALHQIFGAIYGAAFSGVSWTMKILIGVIITWIGMNSRSTSLSVSLVLVGIVTLYLGVMVQADSGCVVSWKNKELKCGSGIFITDNVHTWTEQYKFQPESPSKLASAIQKAQEEGICGIRSVTRLENLMWKQITPELNHILAENEVKLTIMTGDIKGIMQAGKRSLRPQPTELKYSWKTWGKAKMLSTESHNQTFLIDGPETAECPNTNRAWNSLEVEDYGFGVFTTNIWLKLKEKQDAFCDSKLMSAAIKDNRAVHADMGYWIESALNDTWKIEKASFIEVKNCHWPKSHTLWSNGVLESEMIIPKNLAGPVSQHNYRPGYHTQTAGPWHLGKLEMDFDFCDGTTVIVTEDCGNRGPSLRTTTASGKLITEWCCRSCTLPPLRYRGEDGCWYGMEIRPLKEKEENLVNSLVTAGHGQVDNFSLGVLGMALFLEEMLRTRVGTKHAILLVAVSFVTLITGNMSFKDLGRVVVMVGATMTDDIGMGVTYLALLAAFKVRPTFAAGLLLRKLTSKELMMTTIGIVLLSQSTIPETILELTDALALGMMVLKIVRDMEKYQLAVTIMAILCVPNAVILQNAWKVSCTILAVVSVSPLLLTSSQQKTDWIPLALTIKGLNPTAIFLTTLSRTNKKRSWPLNEAIMAVGMVSILASSLLKNDIPMTGPLVAGGLLTVCYVLTGRSADLELERATDVKWEDQAEISGSSPILSITISEDGSMSIKNEEEEQTLTILIRTGLLVISGLFPVSIPITAAAWYLWEVKKQRAGVLWDVPSPPPMGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIIDKKGKVVGLYGNGVVTRSGAYVSAIAQTEKSIEDNPEIEDDIFRKRRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIIDEEREIPERSWNSGHEWVTDFKGKTVWFVPSIKAGNDIAACLRKNGKKVIQLSRKTFDSEYVKTRTNDWDFVVTTDISEMGANFKADRVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRRWCFDGIKNNQILEENVEVEIWTKEGERKKLKPRWLDARIYSDPLALKEFKEFAAGRKSLTLNLITEMGRLPTFMTQKTRDALDNLAVLHTAEAGGRAYNHALSELPETLETLLLLTLLATVTGGIFLFLMSGRGIGKMTLGMCCIITASILLWYAQIQPHWIAASIILEFFLIVLLIPEPEKQRTPQDNQLTYVVIAILTVVAATMANEMGFLEKTKKDLGLGSIATQQPESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQTYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFIPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESEIPNLDIIGKRIEKIKQEHETSWHYDQDHPYKTWAYHGSYETKQTGSASSMVNGVVRLLTKPWDVLPTVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKNIQHLTATEEVAVQNWLARVGRERLSRMAISGDDCVVKPLDDRFANALTALNDMGKIRKDIQQWEPSKGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIRENPWMEDKTPVESWEEIPYLGKREDQWCGSLIGLTSRATWAKNIQAAINQVRSLIGNEEYTDYMPSMKRFRREEEEAGVLW

SEQ ID NO: 3874 - protein, 3291 aa, Artificial Sequence
  derived and/or modified protein sequence (wt) from DENV-2__GU131897__SS-prME
SAGMIIMLIPTVMAFHLTTRNGEPHMIVGIQEKGKSLLFKTEDGVNMCTLMAMDLGELCEDTITYKCPLLRQNEPEDIDCWCNSTSTWVTYGTCTTTGEHRREKRSVALVPHVGMGLETRTETWMSSEGAWKHAQRIETWILRHPGFTIMAAILAYTIGTTHFQRVLIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLKEEQDKRFVCKHSMVDRGWGNGCGLFGKGGIVTCAMFTCKKNMEGKIVQPENLEYTIVVTPHSGEEHAVGNDTGKHGMEIKVTPQSSITEAELTGYGTVTMECSPRTGLDFNEMVLLQMENKAWLVHRQWFLDLPLPWLPGADKQESNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRYVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGIVTLYLGVMVQADSGCVVSWKNKELKCGSGIFITDNVHTWTEQYKFQPESPSKLASAIQKAQEEGICGIRSVTRLENLMWKQITPELNHILAENEVKLTIMTGDIKGIMQAGKRSLRPQPTELKYSWKTWGKAKMLSTESYNQTFLIDGPETAECPNTNRAWNSLEVEDYGFGVFTTNIWLKLKEKQDAFCDSKLMSAAIKDNRAVHADMGYWIESALNDTWKIEKASFIEVKNCHWPKSHTLWSNGVLESEMIIPKNLAGPVSQHNYRPGYHTQIAGPWHLGKLEMDFDFCDGTTVIVTEDCGNRGPSLRTTTASGKLITEWCCRSCTLPPLRYRGEDGCWYGMEIRPLKEKEENLINSLVTAGHGQVDNFSLGVLGMALFLEEMLRTRVGTKHAILLVAVSFVTLITGNMSFKDLGRVVVMVGATMADDIGMGVTYLALLAAFKVRPTFAAGLLLRKLTSKELMMTTIGIVLLSQSTIPETVLELTDALALGMMVLKIVRNMEKYQLAVTIMAILCVPNAVILQNAWKVSCTILAVVSVSPLLLTSSQQKTDWIPLALTIKGLNPTAIFLTTLSRTNKKRSWPLNEAIMAVGMVSILASSLLKNDIPMTGPLVAGGLLTVCYVLTGRSADLELERATDVKWEDQAEISGSSPILSITISEDGSMSIKNEEEEQTLTILIRTGLLVISGLFPISIPITAAAWYLWEVKKQRAGVLWDVPSPPPMGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIIDKKGKVVGLYGNGVVTRSGAYVSAIAQTEKSIEDNPEIEDDIFRKRRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIIDEEREIPERSWNSGHEWVMDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRRWCFDGIKNNQILEENVEVEIWTKEGERKKLKPRWLDARIYSDPLALKEFKEFAAGRKSLTLNLITEMGRLPTFMTQKTRDALDNLAVLHTAEAGGRAYNHALSELPETLETLLLLTLLATVTGGIFLFLMSGRGIGKMTLGMCCIITASILLWYAQIQPHWIAASIILEFFLIVLLIPEPEKQRTPQDNQLTYVVIAILTVVAATMANEMGFLEKTKKDLGLGSIATQQPESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFIPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESEIPNLDIIGKRIEKIKEEHETSWHYDQDHPYKTWAYHGSYETKQTGSASSMVNGVVRLLTKPWDVLPTVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKNIQHLTVTEEAAVQNWLARVGRERLSRMAISGDDCVVKPLDDRFANALTALNDMGKIRKDIQQWEPSKGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIRENPWMEDKTPVESWEEIPYLGKREDQWCGSLIGLTSRATWAKNIQAAINQVRSLIGNEEYTDYMPSMKRFRREEEEAGVLW

SEQ ID NO: 3875 - protein, 3291 aa, Artificial Sequence
  derived and/or modified protein sequence (wt) from DENV-2__GQ868631__SS-prME
SAGMIIMLIPTVMAFHLTTRNGEPHMIVGIQEKGKSLLFKTEDGVNMCTLMAMDLGELCEDTITYKCPLLRQNEPEDIDCWCNSTSTWVTYGTCTTKGEHRREKRSVALVPHVGMGLETRTETWMSSEGAWKHAQRIETWILRHPGFTIMAAILAYTIGTTHFQRVLIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLKEEQDKRFVCKHSMVDRGWGNGCGLFGKGGIVTCAMFTCKKNMEGKIVQPENLEYTIVVTPHSGEEHAVGNDTGKHGMEIKVTPQSSITEAELTGYGTVTMECSPRTGLDFNEMVLLQMENKAWLVHRQWFLDLPLPWLPGADKQESNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRYVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGVAFSGVSWTMKILIGVIITWIGMNSRSTSLSVSLVLVGIVTLYLGVMVQADSGCVVSWKNKELKCGSGIFITDNVHTWTEQYKFQPESPSKLASAIQKAQEEGICGIRSVTRLENLMWKQITPELNHILAENEVKLTIMTGDIKGIMQAGKRSLRPQPTELKYSWKTWGKAKMLSTESYNQTFLIDGPETAECPNTNRAWNSLEVEDYGFGVFTTNIWLKLKEKQDAFCDSKLMSAAIKDNRAVHADMGYWIESALNDTWKIEKASFIEVKNCHWPKSHTLWSNGVLESEMIIPKNLAGPVSQHNYRPGYHTQIAGPWHLGKLEMDFDFCDGTTVIVTEDCGNRGPSLRTTTASGKLITEWCCRSCTLPPLRYRGEDGCWYGMEIRPLKEKEENLVNSLVTAGHGQVDNFSLGVLGMALFLEEMLRTRVGTKHAILLVAVSFVTLITGNMSFKDLGRVVVMVGATMADDIGMGVTYLALLAAFKVRPTFAAGLLLRKLTSKELMMATIGIVLLSQSTIPETVLELTDALALGMMALKIVRNMEKYQLAVTIMAILCVPNAVILQNAWKVSCTILAVVSVSPLLLTSSQQKTDWIPLALTIKGLNPTAIFLTTLSRTNKKRSWPLNEAIMAVGMVSILASSLLKNDIPMTGPLVAGGLLTVCYVLTGRSADLELERATDVKWEDQAEISGSSPILSITISEDGSMSIKNEEEEQTLTILIRTGLLVISGLFPISIPITAAAWYLWEVKKQRAGVLWDVPSPPPMGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIIDKKGKVVGLYGNGVVTRSGAYVSAIAQTEKSIEDNPEIEDDIFRKRRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIIDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRRWCFDGIKNNQILEENVEVEIWTKEGERKKLKPRWLDARIYSDPLALKEFKEFAAGRKSLTLNLITEMGRLPTFMTQKTRDALDNLAVLHTAEAGGRAYNHALSELPETLETLLLLTLLATVTGGIFLFLMSGRGIGKMTLGMCCIITASILLWYAQIQPHWIAASIILEFFLIVLLIPEPEKQRTPQDNQLTYVVIAILTVVAATMANEMGFLEKTKKDLGLGSIATQQPESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFIPPEKCDTLLCDIGESSPNPTVEAGRTLRVLNLVENWLNNNTQFCIKVLNPYMPSVIEKMEAMQRKYGGALVRNPLSRNSTHEMYWVSNASGNIVSSVNMISRMLINRFTMRHKKATYEPDVDLGSGTRNIGIESEIPNLDIIGKRIEKIKEEHETSWHYDQDHPYKTWAYHGSYETKQTGSASSMVNGVVRLLTKPWDVLPTVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKNIQHLTVTEEAAVQNWLARVGRERLSRMAISGDDCVVKPLDDRFANALTALNDMGKIRKDIQQWEPSKGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIRENPWMEDKTPVESWEEIPYLGKREDQWCGSLIGLTSRATWAKNIQAAINQVRSLIGNEEYTDYMPSMKRFRREEEEAGVLW

SEQ ID NO: 3876 - protein, 3291 aa, Artificial Sequence
  derived and/or modified protein sequence (wt) from DENV-2__GU131899__SS-prME
SAGMIIMLIPTVMAFHLTTRNGEPHMIVGIQEKGKSLLFKTEDGVNMCTLMAMDLGELCEDTITYKCPLLRQNEPEDIDCWCNSTSTWVTYGTCTTTGEHRREKRSVALVPHVGMGLETRTETWMSSEGAWKHAQRIETWILRHPGFTIMAAILAYTIGTTHFQRVLIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLKEEQDKRFVCKHSMVDRGWGNGCGLFGKGGIVTCAMFTCKKNMEGKIVQPENLEYTIVVTPHSGEEHAVGNDTGKHGKEIKVTPQSSITEAELTGYGTVTMECSPRTGLDFNEMVLLQMENKAWLVHRQWFLDLPLPWLPGADKQESNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRYVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGIVTLYLGVMVQADSGCVVSWKNKELKCGSGIFITDNVHTWTEQYKFQPESPSKLASAIQKAQEEGICGIRSVTRLENLMWKQITPELNHILAENEVKLTIMTGDIKGIMQAGKRSLRPQPTELKYSWKTWGKAKMLSTESYNQTFLIDGPETAECPNTNRAWNSLEVEDYGFGVFTTNIWLKLKEKQDAFCDSKLMSAAIKDNRAVHADMGYWIESALNDTWKIEKASFIEVKNCHWPKSHTLWSNGVLESEMIIPKNLAGPVSQHNYRPGYHTQIAGPWHLGKLEMDFDFCDGTTVIVTEDCGNRGPSLRTTTASGKLITEWCCRSCTLPPLRYRGEDGCWYGMEIRPLKEKEENLVNSLVTAGHGQVDNFSLGVLGMALFLEEMLRTRVGTKHAILLVAVSFVTLITGNMSFKDLGRVVVMVGATMADDIGMGVTYLALLAAFKVRPTFAAGLLLRKLTSKELMMTTIGIVLLSQSTIPETVLELTDALALGMMVLKIVRNMEKYQLAVTIMAILCVPNAVILQNAWKVSCTILAVVSVSPLLLTSSQQKTDWIPLALTIKGLNPTAIFLTTLSRTNKKRSWPLNEAIMAVGMVSILASSLLKNDIPMTGPLVAGGLLTVCYVLTGRSADLELERATDVKWEDQAEISGSSPILSITISEDGSMSIKNEEEEQTLTILIRTGLLVISGLFPISIPVTAAAWYLWEVKKQRAGVLWDVPSPPPMGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIIDKKGKVVGLYGNGVVTRSGAYVSAIAQTEKSIEDNPEIEDDIFRKRRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIIDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRRWCFDGIKNNQILEENMEVEIWTKEGERKKLKPRWLDARIYSDPLALKEFKEFAAGRKSLTLNLITEMGRLPTFMTQKTRDALDNLAVLHTAEAGGRAYNHALSELPETLETLLLLTLLATVTGGIFLFLMSGRGIGKMTLGMCCIITASILLWYAQIQPHWIAASIILEFFLIVLLIPEPEKQRTPQDNQLTYVVIAILTVVAATMANEMGFLEKTKKDLGLGSIATQQPESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNMGETLGEKWKSRLNALGKSEFQIYKRSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFIPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESEIPNLDIIGKRIEKIKQEHETSWHYDQDHPYKTWAYHGSYETKQTGSASSMVNGVVRLLTKPWDVLPTVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGVFKNIQHLTVTEEVAVQNWLARVGRERLSRMAISGDDCVVKPLDDRFANALTALNDMGKIRKDIQQWEPSKGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIRENPWMEDKTPVESWEEIPYLGKREDQWCGSLIGLTSRATWAKNIQAAINQVRSLIGNEEYTDYMPSMKRFRREEEEAGVLW

SEQ ID NO: 3877 - protein, 3291 aa, Artificial Sequence
  derived and/or modified protein sequence (wt) from DENV-2__GU131900__SS-prME
SAGMIIMLIPTVMAFHLTTRNGEPHMIVGIQEKGKSLLFKTEDGVNMCTLMAMDLGELCEDTITYKCPLLRQNEPEDIDCWCNSTSTWVTYGTCTTTGEHRREKRSVALVPHVGMGLETRTETWMSSEGAWKHAQRIETWILRHPGFTIMAAILAYTIGTTHFQRVLIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLKEEQDKRFVCKHSMVDRGWGNGCGLFGKGGIVTCAMFTCKKNMEGKIVQPENLEYTIVVTPHSGEEHAVGNDTGKHGMEIKVTPQSSITEAELTGYGTVTMECSPRTGLDFNEMVLLQMENKAWLVHRQWFLDLPLPWLPGADKQESNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRYVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGIVTLYLGVMVQADSGCVVSWKNKELKCGSGIFITDNVHTWTEQYKFQPESPSKLASAIQKAQEEGICGIRSVTRLENLMWKQITPELNHILAENEVKLTIMTGDIKGIMQAGKRSLRPQPTELKYSWKTWGKAKMLSTESYNQTFLIDGPETAECPNTNRAWNSLEVEDYGFGVFTTNIWLKLKEKQDAFCDSKLMSAAIKDNRAVHADMGYWIESALNDTWKIEKASFIEVKNCHWPKSHTLWSNGVLESEMIIPKNLAGPVSQHNYRPGYHTQIAGPWHLGKLEMDFDFCDGTTVIVTEDCGNRGPSLRTTTASGKLITEWCCRSCTLPPLRYRGEDGCWYGMEIRPLKEKEENLVNSLVTAGHGQVDNFSLGVLGMALFLEEMLRTRVGTKHAILLVAVSFVTLITGNMSFKDLGRVVVMVGATMADDIGMGVTYLALLAAFKVRPTFAAGLLLRKLTSKELMMTTIGIVLLSQSTIPETVLELTDALALGMMVLKIVRNMEKYQLAVTIMAILCVPNAVILQNAWKVSCTILAVVSVSPLLLTSSQQKTDWIPLALTIKGLNPTAIFLTTLSRTNKKRSWPLNEAIMAVGMVSILASSLLKDDIPMTGPLVAGGLLTVCYVLTGRSADLELERATDVKWEDQAEISGSSPILSITISEDGSMSIKNEEEEQTLTILIRTGLLVISGLFPISIPITAAAWYLWEVKKQRAGVLWDVPSPPPMGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIIDKKGKVVGLYGNGVVTRSGAYVSAIAQTEKSIEDNPEIEDDIFRKRRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIIDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRRWCFDGIKNNQILEENVEVEIWTKEGERKKLKPRWLDARIYSDPLALKEFKEFAAGRKSLTLNLITEMGRLPTFMTQKTRDALDNLAVLHTAEAGGRAYNHALSELPETLETLLLLTLLATVTGGIFLFLMSGRGIGKMTLGMCCIITASILLWYAQIQPHWIAASIILEFFLIVLLIPEPEKQRTPQDNQLTYVVIAILTVVAATMANEMGFLEKTKKDLGLGSIATQQPESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFIPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESEIPNLDIIGKRIEKIKEEHETSWHYDQDHPYKTWAYHGSYETKQTGSASSMVNGVVRLLTKPWDVLPTVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKNIQHLTVTEEAAVQNWLARVGRERLSRMAISGDDCVVKPLDDRFANALTALNDMGKIRKDIQQWEPSKGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIRENPWMEDKTPVESWEEIPYLGKREDQWCGSLIGLTSRATWAKNIQAAINQVRSLIGNEEYTDYMPSMKRFRREEEEAGVLW

SEQ ID NO: 3878 - protein, 3291 aa, Artificial Sequence
  derived and/or modified protein sequence (wt) from DENV-2__GU131901__SS-prME
SAGMIIMLIPTVMAFHLTTRNGEPHMIVGIQEKGKSLLFKTEDGVNMCTLMAMDLGELCEDTITYKCPLLRQNEPEDIDCWCNSTSTWVTYGTCTTTGEHRREKRSVALVPHVGMGLETRTETWMSSEGAWKHAQRIETWILRHPGFTIMAAILAYTIGTTHFQRVLIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLKEEQDKRFVCKHSMVDRGWGNGCGLFGKGGIVTCAMFTCKKNMEGKIVQPENLEYTIVVTPHSGEEHAVGNDTGKHGMEIKVTPQSSITEAELTGYGTVTMECSPRTGLDFNEMVLLQMENKAWLVHRQWFLDLPLPWLPGADKQESNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRYVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGIVTLYLGVMVQADSGCVVSWKNKELKCGSGIFITDNVHTWTEQYKFQPESPSKLASAIQKAQEEGICGIRSVTRLENLMWKQITPELNHILAENEVKLTIMTGDIKGIMQAGKRSLRPQPTELKYSWKTWGKAKMLSTESYNQTFLIDGPETAECPNTNRAWNSLEVEDYGFGVFTTNIWLKLKEKQDAFCDSKLMSAAIKDNRAVHADMGYWIESALNDTWKIEKASFIEVKNCHWPKSHTLWSNGVLESEMIIPKNLAGPVSQHNYRPGYHTQIAGPWHLGKLEMDFDFCDGTTVIVTEDCGNRGPSLRTTTASGKLITEWCCRSCTLPPLRYRGEDGCWYGMEIRPLKEKEENLVNSLVTAGHGQVDNFSLGVLGMALFLEEMLRTRVGTKHAILLVAVSFVTLITGNMSFKDLGRVVVMVGATMADDIGMGVTYLALLAAFKVRPTFAAGLLLRKLTSKELMMTTIGIVLLSQSTIPETVLELTDALALGMMVLKIVRNMEKYQLAVTIMAILCVPNAVILQNAWKVSCTILAVVSVSPLLLTSSQQKTDWIPLALTIKGLNPTAIFLTTLSRTNKKRSWPLNEAIMAVGMVSILASSLLKNDIPMTGPLVAGGLLTVCYVLTGRSADLELERATDVKWEDQAEISGSSPILSITISEDGSMSIKNEEEEQTLTILIRTGLLVISGLFPISIPITAAAWYLWEVKKQRAGVLWDVPSPPPMGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIIDKKGKVVGLYGNGVVTRSGAYVSAIAQTEKSIEDNPEIEDDIFRKRRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIIDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRRWCFDGIKNNQILEENVEVEIWTKEGERKKLKPRWLDARIYSDPLALKEFKEFAAGRKSLTLNLITEMGRLPTFMTQKTRDALDNLAVLHTAEAGGRAYNHALSELPETLETLLLLTLLATVTGGIFLFLMSGRGIGKMTLGMCCIITASILLWYAQIQPHWIAASIILEFFLIVLLIPEPEKQRTPQDNQLTYVVIAILTVVAATMANEMGFLEKTKKDLGLGSIATQQPESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNVGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFIPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESEIPNLDIIGKRIEKIKEEHETSWHYDQDHPYKTWAYHGSYETKQTGSASSMVNGVVRLLTKPWDVLPTVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKNIQHLTVTEEAAVQNWLARVGRERLSRMAISGDDCVVKPLDDRFANALTALNDMGKIRKDIQQWEPSKGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIRENPWMEDKTPVESWEEIPYLGKREDQWCGSLIGLTSRATWAKNIQAAINQVRSLIGNEEYTDYMPSMKRFRREEEEAGVLW

SEQ ID NO: 3879 - protein, 3291 aa, Artificial Sequence
  derived and/or modified protein sequence (wt) from DENV-2__GU131902__SS-prME
SAGMIIMLIPTVMAFHLTTRNGEPHMIVGIQEKGKSLLFKTEDGVNMCTLMAMDLGELCEDTITYKCPLLRQNEPEDIDCWCNSTSTWVTYGTCTTTGEHRREKRSVALVPHVGMGLETRTETWMSSEGAWKHAQRIETWILRHPGFTIMAAILAYTIGTTHFQRVLIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLKEEQDKRFVCKHSMVDRGWGNGCGLFGKGGIVTCAMFTCKKNMEGKIVQPENLEYTIVVTPHSGEEHAVGNDTGKHGMEIKVTPQSSITEAELTGYGTVTMECSPRTGLDFNEMVLLQMENKAWLVHRQWFLDLPLPWLPGADKQESNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRYVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGIVTLYLGVMVQADSGCVVSWKNKELKCGSGIFITDNVHTWTEQYKFQPESPSKLASAIQKAQEEGICGIRSVTRLENLMWKQITPELNHILAENEVKLTIMTGDIKGIMQAGKRSLRPQPTELKYSWKTWGKAKMLSTESYNQTFLIDGPETAECPNTNRAWNSLEVEDYGFGVFTTNIWLKLKEKQDAFCDSKLMSAAIKDNRAVHADMGYWIESALNDTWKIEKASFIEVKNCHWPKSHTLWSNGVLESEMIIPKNLAGPVSQHNYRPGYHTQIAGPWHLGKLEMDFDFCDGTTVIVTEDCGNRGPSLRTTTASGKLIAEWCCRSCTLPPLRYRGEDGCWYGMEIRPLKEKEENLVNSLVTAGHGQVDNFSLGVLGMALFLEEMLRTRVGTKHAILLVAVSFVTLITGNMSFKDLGRVVVMVGATMADDIGMGVTYLALLAAFKVRPTFAAGLLLRKLTSKELMMTTIGIVLLSQSTIPETVLELTDALALGMMVLKIVRNMEKYQLAVTIMAILCVPNAVILQNAWKVSCTILAVVSVSPLLLTSSQQKTDWIPLALTIKGLNPTAIFLTTLSRTNKKRSWPLNEAIMAVGMVSILASSLLKNDIPMTGPLVAGGLLTVCYVLTGRSADLELERATDVKWEDQAEISGSSPILSITISEDGSMSIKNEEEEQTLTILIRTGLLVISGLFPISIPITAAAWYLWEVKKQRAGVLWDVPSPPPMGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIIDKKGKVVGLYGNGVVTRSGAYVSAIAQTEKSIEDNPEIEDDIFRKRRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIIDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRRWCFDGIKNNQILEENVEVEIWTKEGERKKLKPRWLDARIYSDPLALKEFKEFAAGRKSLTLNLITEMGRLPTFMTQKTRDALDNLAVLHTAEAGGRAYNHALSELPETLETLLLLTLLATVTGGIFLFLMSGRGIGKMTLGMCCIITASILLWYAQIQPHWIAASIILEFFLIVLLIPEPEKQRTPQDNQLTYVVIAILTVVAATMANEMGFLEKTKKDLGLGSIATQQPESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFIPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESEIPNLDIIGKRIEKIKEEHETSWHYDQDHPYKTWAYHGSYETKQTGSASSMVNGVVRLLTKPWDVLPTVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKNIQHLTVTEEAAVQNWLARVGRERLSRMAISGDDCVVKPLDDRFANALTALNDMGKIRKDIQQWEPSKGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIRENPWMEDKTPVESWEEIPYLGKREDQWCGSLIGLTSRATWAKNIQAAINQVRSLIGNEEYTDYMPSMKRFRREEEEAGVLW

SEQ ID NO: 3880 - protein, 3291 aa, Artificial Sequence
  derived and/or modified protein sequence (wt) from DENV-2__GU131924__SS-prME
SAGMIIMLIPTVMAFHLTTRNGEPHMIVGIQEKGKSLLFKTEDGVNMCTLMAMDLGELCEDTITYKCPLLRQNEPEDIDCWCNSTSTWVTYGTCTTTGEHRREKRSVALVPHVGMGLETRTETWMSSEGAWKHAQRIETWILRHPGFTIMAAILAYTIGTTHFQRVLIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLKEEQDKRFVCKHSMVDRGWGNGCGLFGKGGIVTCAMFTCKKNMEGKIVQPENLEYTIVVTPHSGEEHAVGNDTGKHGMEIKVTPQSSITEAELTGYGTVTMECSPRTGLDFNEMVLLQMENKAWLVHRQWFLDLPLPWLPGADKQESNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRYVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGIVTLYLGVMVQADSGCVVSWKNKELKCGSGIFITDNVHTWTEQYKFQPESPSKLASAIQKAQEEGICGIRSVTRLENLMWKQITPELNHILAENEVKLTIMTGDIKGIMQAGKRSLRPQPTELKYSWKTWGKAKMLSTESYNQTFLIDGPETAECPNTNRAWNSLEVEDYGFGVFTTNIWLKLKEKQDAFCDSKLMSAAIKDNRAVHADMGYWIESALNDTWKIEKASFIEVKNCHWPKSHTLWSNGVLESEMIIPKNLAGPVSQHNYRPGYHTQIAGPWHLGKLEMDFDFCDGTTVIVTEDCGNRGPSLRTTTASGKLITEWCCRSCTLPPLRYRGEDGCWYGMEIRPLKEKEENLVNSLVTAGHGQVDNFSLGVLGMALFLEEMLRTRVGTKHAILLVAVSFVTLITGNMSFKDLGRVVVMVGATMADDIGMGVTYLALLAAFKVRPTFAAGLLLRKLTSKELMMTTIGIVLLSQSTIPETVLELTDALALGMMVLKIVRNMEKYQLAVTIMAILCVPNAVILQNAWKVSCTILAVVSVSPLLLTSSQQKTDWIPLALTIKGLNPTAIFLTTLSRTNKKRSWPLNEAIMAVGMVSILASSLLKNDIPMTGPLVAGGLLTVCYVLTGRSADLELERATDVKWEDQAEISGSSPILSITISEDGSMSIKNEEEEQTLTILIRTGLLVISGLFPISIPITAAAWYLWEVKKQRAGVLWDVPSPPPMGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIIDKKGKVVGLYGNGVVTRSGAYVSAIAQTEKSIEDNPEIEDDIFRKRRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIIDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRRWCFDGIKNNQILEENVEVEIWTKEGERKKLKPRWLDARIYSDPLALKEFKEFAAGRKSLTLNLITEMGRLPTFMTQKTRDALDNLAVLHTAEAGGRAYNHALSELPETLETLLLLTLLATVTGGIFLFLMSGRGIGKMTLGMCCIITASILLWYAQIQPHWIAASIILEFFLIVLLIPEPEKQRTPQDNQLTYVVIAILTVVAATMANEMGFLEKTKKDLGLGSIATQQPESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLILCVTQVLMMRTTWALCEALTLATGPISTLWEGNPGRFWNTTIAVSMANIFRGSYLAGAGLLFSIKKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFIPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESEIPNLDIIGKRIEKIKEEHETSWHYDQDHPYKTWAYHGSYETKQTGSASSMVNGVVRLLTKPWDVLPTVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEIVTNHMEGEHKKLAEAIFKLTYQNKVVRVQRPTPRGTVMDIISRRDQRGSGQVGTYGLNTFTNMEAQLIRQMEGEGVFKNIQHLTVTEEAAVQNWLARVGRERLSRMAISGDDCVVKPLDDRFANALTALNDMGKIRKDIQQWEPSKGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIRENPWMEDKTPVESWEEIPYLGKREDQWCGSLIGLTSRATWAKNIQAAINQVRSLIGNEEYTDYMPSMKRFRREEEEAGVLW

SEQ ID NO: 3881 - protein, 3291 aa, Artificial Sequence
  derived and/or modified protein sequence (wt) from DENV-2__GQ868638__SS-prME
SAGMIIMLIPTVMAFHLTTRNGEPHMIVGIQEKGKSLLFKTEDGVNMCTLMAMDLGELCEDTITYKCPLLRQNEPEDIDCWCNSTSTWVTYGTCTTTGEHRREKRSVALVPHVGMGLETRTETWMSSEGAWKHAQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLKEEQDKRFVCKHSMVDRGWGNGCGLFGKGGIVTCAMFTCKKNMEGKIVQPENLEYTIVVTPHSGEEHAVGNDTGKHGKEIKVTPQSSITEAELTGYGTVTMECSPRTGLDFNEMVLLQMENKAWLVHRQWFLDLPLPWLPGADKQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRLQYEGDGSPCKIPFEIMDLEKRYVLGRLITVNPIVTEKDSPVNIEAEPPFGDSYIIIGVEPGQLKLNWFKKGSSIGQMFETTMRGAKRMAILGDTAWDFGSLGGVFTSVGKALHQIFGAIYGAAFSGVSWTMKILIGVIITWIGMNSRSTSLSVSLVLVGIVTLYLGVMVQADSGCVVSWKNKELKCGSGIFITDNVHTWTEQYKFQPESPSKLASAIQKAQEEGICGIRSVTRLENLMWKQITPELNHILAENEVKLTIMTGDIKGIMQAGKRSLRPQPTELKYSWKTWGKAKMLSTESHNQTFLIDGPETAECPNTNRAWNSLEVEDYGFGVFTTNIWLKLKEKQDAFCDSKLMSAAIKDNRAVHADMGYWIESALNDTWKIEKASFIEVKNCHWPKSHTLWSNGVLESEMIIPKNLAGPVSQHNYRPGYHTQTAGPWHLGKLEMDFDFCDGTTVIVTEDCGNRGPSLRTTTASGKLITEWCCRSCTLPPLRYRGEDGCWYGMEIRPLKEKEENLVNSLVTAGHGQVDNFSLGVLGMALFLEEMLRTRVGTKHAILLVAVSFVTLITGNMSFKDLGRVVVMVGATMTDDIGMGVTYLALLAAFKVRPTFAAGLLLRKLTSKELMMTTIGIVLLSQSTIPETILELTDALALGMMVLKIVRDMEKYQLAVTIMAILCVPNAVILQNAWKVSCTILAVVSVSPLLLTSSQQKTDWIPLALTIKGLNPTAIFLTTLSRTNKKRSWPLNEAIMAVGMVSILASSLLKNDIPMTGPLVAGGLLTVCYVLTGRSADLELERATDVKWEDQAEISGSSPILSITISEDGSMSIKNEEEEQTLTILIRTGLLVISGLFPVSIPITAAAWYLWEVKKQRAGVLWDVPSPPPMGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIIDKKGKVVGLYGNGVVTRSGAYVSAIAQTEKSIEDNPEIEDDIFRKRRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIIDEEREIPERSWNSGHEWVTDFKGKTVWFVPSIKAGNDIAACLRKNGKKVIQLSRKTFDSEYVKTRTNDWDFVVTTDISEMGANFKADRVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRRWCFDGIKNNQILEENVEVEIWTKEGERKKLKPRWLDARIYSDPLALKEFKEFAAGRKSLTLNLITEMGRLPTFMTQKTRDALDNLAVLHTAEAGGRAYNHALSELPETLETLLLLTLLATVTGGIFLFLMSGRGIGKMTLGMCCIITASILLWYAQIQPHWIAASIILEFFLIVLLIPEPEKQRTPQDNQLTYVVIAILTVVAATMANEMGFLEKTKKDLGLGSIATQQPESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQTYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFIPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESEIPNLDIIGKRIEKIKQEHETSWHYDQDHPYKTWAYHGSYETKQTGSASSMVNGVVRLLTKPWDVLPTVTQMAMTDTTPFGQQRVFKEKVDTRAQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFRNIQHLTATEEVAVQNWLARVGRERLSRMAISGDDCVVKPLDDRFANALTALNDMGKIRKDIQQWEPSKGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIRENPWMEDKTPVESWEEIPYLGKREDQWCGSLIGLTSRATWAKNIQAAINQVRSLIGNEEYTDYMPSMKRFRREEEEAGVLW

SEQ ID NO: 3882 - protein, 3291 aa, Artificial Sequence
  derived and/or modified protein sequence (wt) from DENV-2__GU131927__SS-prME
SAGMIIMLIPTVMAFHLTTRNGEPHMIVGIQEKGKSLLFKTEDGVNMCTLMAMDLGELCEDTITYKCPLLRQNEPEDIDCWCNSTSTWVTYGTCTTTGEHRREKRSVALVPHVGMGLETRTETWMSSEGAWKHAQRIETWILRHPGFTIMAAILAYTIGTTHFQRALIFILLTAVAPSMTMRCIGISNRDFVEGVSGGSWVDIVLEHGSCVTTMARNKPTLDFELIKTEAKQPATLRKYCIEAKLTNTTTESRCPTQGEPSLKEEQDKRFVCKHSMVDRGWGNGCGLFGKGGIVTCAMFTCKKNMEGKIVQPENLEYTIVVTPHSGEEHAVGNDTGKHGKEIKVTPQSSITEAELTGYGTVTMECSPRTGLDFNEMVLLQMENKAWLVHRQWFLDLPLPWLPGADKQESNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRYVLGRLITVNPIVTEKDSPVNIEAEPPFGDSYIIIGVEPGQLKLNWFKKGSSIGQMFETTMRGAKRMAILGDTAWDFGSLGGVFTSVGKALHQVFGAIYGAAFSGVSWTMKILIGVIITWIGMNSRSTSLSVSLVLVGIVTLYLGVMVQADSGCVVSWKNKELKCGSGIFITDNVHTWTEQYKFQPESPSKLASAIQKAQEEGICGIRSVTRLENLMWKQITPELNHILAENEVKLTIMTGDIKGIMQAGRRSLRPQPTELKYSWKTWGKAKMLSTESYNQTFLIDGPETTECPNANRAWNSLEVEDYGFGVFTTNIWLKLKEKQDAFCDSKLMSAAIKDNRAVHADMGYWIESALNDTWKIEKASFIEVKNCHWPKSHTLWSNGVLESEMIIPKSLAGPVSQHNYRPGYHTQIAGPWHLGKLEMDFDFCDGTTVIVTEDCGNRGPSLRTTTASGKLITEWCCRSCTLPPLRYRGEDGCWYGMEIRPLKEKEENLVNSLVTAGHGQVDNFSLGVLGMALFLEEMLRTRVGTKHAILLVAVSFVTLITGNMSFKDLGRVVVMVGATMADDIGMGVTYLALLAAFKVRPTFAAGLLLRKLTSKELMMTTIGIVLLSQSTIPETILELTDALALGMMVLKIVRNMEKYQLAVTIMAILCVPNAVILQNAWKVSCTILAVVSVSPLLLTSSQQKTDWIPLALTIKGLNPTAIFLTTLSRTNKKRSWPLNEAIMAVGMVSILASSLLKNDIPMTGPLVAGGLLTVCYVLTGRSADLELERATDVKWEEQAEISGSSPILSITISEDGSMSIKNEEEEQTLTILIRTGLLVISGLFPISIPITAAAWYLWEVKKQRAGVLWDVPSPPPMGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIIDKKGKVVGLYGNGVVTRSGAYVSAIAQTEKSTEDNPEIEDDIFRKRRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIIDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRRWCFDGIKNNQILEENVEVEIWTKEGERKKLKPRWLDARIYSDPLALKEFKEFAAGRKSLTLNLITEMGRLPTFMTQKTRDALDNLAVLHTAEAGGRAYNHALSELPETLETLLLLTLLATVTGGIFLFLMSGRGIGKMTLGMCCIITASILLWYAQIQPHWIAASIILEFFLIVLLIPEPEKQRTPQDNQLTYVVIAILTVVAATMANEMGFLEKTKKDLGLGSIATQQPESNILDIDLRPASAWTLYAVATTFITPMLRHSIENSSVNTSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVKEVKGLTKGGPGHEEPIPMSTYGWNLVRLQSGVDVFFIPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESEVPNLDIIGKRIEKIKQEHETSWHYDQDHPYKTWAYHGSYETTQTGSASSMVNGVVRLLTKPWDVLPTVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGVFKNIQHLTVTEEVAVQNWLARVGRERLSRMAISGDDCVVKPLDDRFANALTALNDMGKIRKDIQQWEPSKGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIRENPWMEDKTPVESWEEIPYLGKREDQWCGSLIGLTSRATWAKNIQAAINQVRSLIGNEEYTDYMPSMKRFRREEEEAGVLW

SEQ ID NO: 3883 - protein, 3291 aa, Artificial Sequence
  derived and/or modified protein sequence (wt) from DENV-2__GU131928__SS-prME
SAGMIIMLIPTVMAFHLTTRNGEPHMIVGIQEKGKSLLFKTEDGVNMCTLMAMDLGELCEDTITYKCPLLRQNEPEDIDCWCNSTSTWVTYGTCTTTGEHRREKRSVALVPHVGMGLETRTETWMSSEGAWKHAQRIETWILRHPGFTIMAAILAYTIGTTHFQRVLIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLKEEQDKRFVCKHSMVDRGWGNGCGLFGKGGIVTCAMFTCKKNMEGKIVQPENLEYTIVVTPHSGEEHAVGNDTGKHGMEIKVTPQSSITEAELTGYGTVTMECSPRTGLDFNEMVLLQMENKAWLVHRQWFLDLPLPWLPGADKQESNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRYVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGVAFSGVSWTMKILIGVIITWIGMNSRSTSLSVSLVLVGIVTLYLGVMVQADSGCVVSWKNKELKCGSGIFITDNVHTWTEQYKFQPESPSKLASAIQKAQEEGICGIRSVTRLENLMWKQITPELNHILAENEVKLTIMTGDIKGIMQAGKRSLRPQPTELKYSWKTWGKAKMLSTESYNQTFLIDGPETAECPNTNRAWNSLEVEDYGFGVFTTNIWLKLKEKQDAFCDSKLMSAAIKDNRAVHADMGYWIESALNDTWKIEKASFIEVKNCHWPKSHTLWSNGVLESEMIIPKNLAGPVSQHNYRPGYHTQIAGPWHLGKLEMDFDFCDGTTVIVTEDCGNRGPSLRTTTASGKLITEWCCRSCTLPPLRYRGEDGCWYGMEIRPLKEKEENLVNSLVTAGHGQVDNFSLGVLGMALFLEEMLRTRVGTKHAILLVAVSFVTLITGNMSFKDLGRVVVMVGATMADDIGMGVTYLALLAAFKVRPTFAAGLLLRKLTSKELMMTTIGIVLLSQSTIPETVLELTDALALGMMVLKIVRNMEKYQLAVTIMAILCVPNAVILQNAWKVSCTILAVVSVSPLLLTSSQQKTDWIPLALTIKGLNPTAIFLTTLSRTNKKRSWPLNEAIMAVGMVSILASSLLKNDIPMTGPLVAGGLLTVCYVLTGRSADLELERATDVKWEDQAEISGSSPILSITISEDGSMSIKNEEEEQTLTILIRTGLLVISGLFPISIPITAAAWYLWEVKKQRAGVLWDVPSPPPMGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIIDKKGKVVGLYGNGVVTRSGAYVSAIAQTEKSIEDNPEIEDDIFRKRRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIIDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRRWCFDGIKNNQILEENVEVEIWTKEGERKKLKPRWLDARIYSDPLALKEFKEFAAGRKSLTLNLITEMGRLPTFMTQKTRDALDNLAVLHTAEAGGRAYNHALSELPETLETLLLLTLLATVTGGIFLFLMSGRGIGKMTLGMCCIITASILLWYAQIQPHWIAASIILEFFLIVLLIPEPEKQRTPQDNQLTYVVIAILTVVAATMANEMGFLEKTKKDLGLGSIATQQPESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFIPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESETPNLDIIGKRIEKIKEEHETSWHYDQDHPYKTWAYHGSYETKQTGSASSMVNGVVRLLTKPWDVLPTVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKNIQHLTVTEEAAVQNWLARVGRERLSRMAISGDDCVVKPLDDRFANALTALNDMGKIRKDIQQWEPSKGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIRENPWMEDKTPVESWEEIPYLGKREDQWCGSLIGLTSRATWAKNIQAAINQVRSLIGNEEYTDYMPSMKRFRREEEEAGVLW

SEQ ID NO: 3884 - protein, 3291 aa, Artificial Sequence
  derived and/or modified protein sequence (wt) from DENV-2__GU131929__SS-prME
SAGMIIMLIPTVMAFHLTTRNGEPHMIVGIQEKGKSLLFKTEDGVNMCTLMAMDLGELCEDTITYKCPLLRQNEPEDIDCWCNSTSTWVTYGTCTTTGEHRREKRSVALVPHVGMGLETRTETWMSSEGAWKHAQRIETWILRHPGFTIMAAILAYTIGTTHFQRVLIFILLTAVAPSMTIRCIGISNRDFVEGVSGGSWVDIVLEHGSCVTTMAKNKPTLDFELIKTEAKQPATLRKYCIEAKLTNTTTESRCPTQGEPSLKEEQDKRFVCKHSMVDRGWGNGCGLFGKGGIVTCAMFTCKKNMEGKIVQPENLEYTIVVTPHSGEEHAVGNDTGKHGMEIKVTPQSSITEAELTGYGTVTMECSPRTGLDFNEMVLLQMENKAWLVHRQWFLDLPLPWLPGADKQESNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRYVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGVAFSGVSWTMKILIGVIITWIGMNSRSTSLSVSLVLVGIVTLYLGVMVQADSGCVVSWKNKELKCGSGIFITDNVHTWTEQYKFQPESPSKLASAIQKAQEEGICGIRSVTRLENLMWKQITPELNHILAENEVKLTIMTGDIKGIMQAGKRSLRPQPTELKYSWKTWGKAKMLFTESYNQTFLIDGPETAECPNTNRAWNSLEVEDYGFGVFTTNIWLKLKEKQDAFCDSKLMSAAIKDNRAVHADMGYWIESALNDTWKIEKASFIEVKNCHWPKSHTLWSNGVLESEMIIPKNLAGPVSQHNYRPGYHTQIAGPWHLGKLEMDFDFCDGTTVIVTEDCGNRGPSLRTTTASGKLITEWCCRSCTLPPLRYRGEDGCWYGMEIRPLKEKEENLVNSLVTAGHGQVDNFSLGVLGMALFLEEMLRTRVGTKHAILLVAVSFVTLITGNMSFKDLGRVVVMVGATMADDIGMGVTYLALLAAFKVRPTFAAGLLLRKLTSKELMMTTIGIVLLSQSTIPETVLELTDALALGMMVLKIVRNMEKYQLAVTIMAILCVPNAVILQNAWKVSCTILAVVSVSPLLLTSSQQKTDWIPLALTIKGLNPTAIFLTTLSRTNKKRSWPLNEAIMAVGMVSILASSLLKNDIPMTGPLVAGGLLTVCYVLTGRSADLELERATDVKWEDQAEISGSSPILSITISEDGSMSIKNEEEEQTLTILIRTGLLVISGLFPISIPITAAAWYLWEVKKQRAGVLWDVPSPPPMGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIIDKKGKVVGLYGNGVVTRSGAYVSAIAQTEKSIEDNPEIEDDIFRKRRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIIDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRRWCFDGIKNNQILEENVEVEIWTKEGERKKLKPRWLDARIYSDPLALKEFKEFAAGRKSLTLNLITEMGRLPTFMTQKTRDALDNLAVLHTAEAGGRAYNHALSELPETLETLLLLTLLATVTGGIFLFLMSGRGIGKMTLGMCCIITASILLWYAQIQPHWIAASIILEFFLIVLLIPEPEKQRTPQDNQLTYVVIAILTVVAATMANEMGFLEKTKKDLGLGSIATQQPESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFIPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESETPNLDIIGKRIEKIKEEHETSWHYDQDHPYKTWAYHGSYETKQTGSASSMVNGVVRLLTKPWDVLPTVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKNIQHLTVTEEAAVQNWLARVGRERLSRMAISGDDCVVKPLDDRFANALTALNDMGKIRKDIQQWEPSKGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIRENPWMEDKTPVESWEEIPYLGKREDQWCGSLIGLTSRATWAKNIQAAINQVRSLIGNEEYTDYMPSMKRFRREEEEAGVLW

SEQ ID NO: 3885 - protein, 3291 aa, Artificial Sequence
  derived and/or modified protein sequence (wt) from DENV-2__GU131930__SS-prME
SAGMIIMLIPTVMAFHLTTRNGEPHMIVGIQEKGKSLLFKTEDGVNMCTLMAMDLGELCEDTITYKCPLLRQNEPEDIDCWCNSTSTWVTYGTCTTTGEHRREKRSVALVPHVGMGLETRTETWMSSEGAWKHAQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLKEEQDKRFVCKHSMVDRGWGNGCGLFGKGGIVTCAMFTCKKNMEGKIVQPENLEYTIVVTPHSGEEHAVGNDTGKHGKEIKVTPQSSITEAELTGYGTVTMECSPRTGLDFNEMVLLQMESKAWLVHRQWFLDLPLPWLPGADKQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRYVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGIVTLYLGVMVQADSGCVVSWKNKELKCGSGIFITDNVHTWTEQYKFQPESPSKLASAIQKAQEEGICGIRSVTRLENLMWKQITPELNHILAENEVKLTIMTGDIKGIMQAGKRSLRPQPTELKYSWKTWGKAKMLSTESHNQTFLIDGPETAECPNTNRAWNSLEVEDYGFGVFTTNIWLKLKEKQDAFCDSKLMSAAIKDNRAVHADMGYWIESALNDTWKIEKASFIEVKNCHWPKSHTLWSNGVLESEMIIPKNLAGPVSQHNYRPGYHTQTAGPWHLGKLEMDFDFCDGTTVIVTEDCGNRGPSLRTTTASGKLITEWCCRSCTLPPLRYRGEDGCWYGMEIRPLKEKEENLVNSLVTAGHGQVDNFSLGVLGMALFLEEMLRTRVGTKHAILLVAVSFVTLITGNMSFKDLGRVVVMVGTTMTDDIGMGVTYLALLAAFKVRPTFAAGLLLRKLTSKELMMTTIGIVLLSQSTIPETILELTDALALGMMVLKIVRDMEKYQLAVTIMAILCVPNAVILQNAWKVSCTILAVVSVSPLLLTSSQQKTDWIPLALTIKGLNPTAIFLTTLSRTNKKRSWPLNEAIMAVGMVSILASSLLKNDIPMTGPLVAGGLLTVCYVLTGRSADLELERATDVKWEDQAEISGSSPILSITISEDGSMSIKNEEEEQTLTILIRTGLLVISGLFPVSIPITAAAWYLWEVKKQRAGVLWDVPSPPPMGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIIDKKGKVVGLYGNGVVTRSGAYVSAIAQTEKSIEDNPEIEDDIFRKRRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIIDEEREIPERSWNTGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRRWCFDGIKNNQILEENVEVEIWTKEGERKKLKPRWLDARIYSDPLALKEFKEFAAGRKSLTLNLITEMGRLPTFMTQKTRDALDNLAVLHTAEAGGRAYNHALSELPETLETLLLLTLLATVTGGIFLFLMSGRGIGKMTLGMCCIITASILLWYAQIQPHWIAASIILEFFLIVLLIPEPEKQRTPQDNQLTYVVIAILTVVAATMANEMGFLEKTKKDLGLGSIATQQPESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQTYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFIPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESEIPNLDIIGKRIEKIKQEHETSWHYDQDHPYKTWAYHGSYETKQTGSASSMVNGVVRLLTKPWDVLPTVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKNIQHLTATEEVAVKNWLARVGRERLSRMAISGDDCVVKPLDDRFANALTALNDMGKIRKDIQQWEPSKGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIRENPWMEDKTPVESWEEIPYLGKREDQWCGSLIGLTSRATWAKNIQAAINQVRSLIGNEEYTDYMPSMKRFRREEEEAGVLW

SEQ ID NO: 3886 - protein, 3291 aa, Artificial Sequence
  derived and/or modified protein sequence (wt) from DENV-2__GU131931__SS-prME
SAGMIIMLIPTVMAFHLTTRNGEPHMIVGIQEKGKSLLFKTEDGVNMCTLMAMDLGELCEDTITYKCPLLRQNEPEDIDCWCNSTSTWVTYGTCTTTGEHRREKRSVALVPHVGMGLETRTETWMSSEGAWKHAQRIETWILRHPGFTIMAAILAHTIGTTHFQRVLIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLKEEQDKRFVCKHSMVDRGWGNGCGLFGKGGIVTCAMFTCKKNMEGKIVQPENLEYTIVVTPHSGEEHAVGNDTGKHGMEIKVTPQSSITEAELTGYGTVTMECSPRTGLDFNEMVLLQMENKAWLVHRQWFLDLPLPWLPGADKQESNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRYVLGRLITVNPIVTEKDSPVNIEAEPPFGDSYIIIGVEPGQLKLNWFKKGSSIGQMFETTMRGAKRMAILGDTAWDFGSLGGVFTSIGKALHQIFGAIYGAAFSGVSWTMKILIGVIITWIGMNSRSTSLSVSLVLVGIVTLYLGVMVQADSGCVVSWKNKELKCGSGIFITDNVHTWTEQYKFQPESPSKLASAIQKAQEEGICGIRSVTRLENLMWKQITPELNHILAENEVKLTIMTGDIKGIMQAGKRSLRPQPTELKYSWKTWGKAKMLSTESHNQTFLIDGPETAECPNTNRAWNSLEVEDYGFGVFTTNIWLKLKEKQDAFCDSKLMSAAIKDNRAVHADMGYWIESALNDTWKIEKASFIEVKNCHWPKSHTLWSNGVLESEMIIPKNLAGPVSQHNYRPGYHTQIAGPWHLGKLEMDFDFCDGTTVIVTEDCGNRGPSLRTTTASGKLITEWCCRSCTLPPLRYRGEDGCWYGMEIRPLKEKEENLVNSLVTAGHGQVDNFSLGVLGMALFLEEMLRTRVGTKHAILLVAVSFVTLITGNMSFKDLGRVVVMVGATMADDIGMGVTYLALLAAFKVRPTFAAGLLLRKLTSKELMMTTIGIVLLSQSTIPETVLELTDALALGMMVLKIVRNMEKYQLAVTIMAILCVPNAVILQNAWKVSCTILAVVSVSPLLLTSSQQKTDWIPLALTIKGLNPTAIFLTTLSRTNKKRSWPLNEAIMAVGMVSILASSLLKNDIPMTGPLVAGGLLTVCYVLTGRSADLELERATDVKWEDQAEISGSSPILSITISEDGSMSIKNEEEEQTLTILIRTGLLVISGLFPISIPITAAAWYLWEVKKQRAGVLWDVPSPPPMGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIIDKKGKVVGLYGNGVVTRSGAYVSAIAQTEKSIEDNPEIEDDIFRKRRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIIDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRRWCFDGIKNNQILEENVEVEIWTKEGERKKLKPRWLDARIYSDPLALKEFKEFAAGRKSLTLNLITEMGRLPTFMTQKTRDALDNLAVLHTAEAGGRAYNHALSELPETLETLLLLTLLATVTGGIFLFLMSGRGIGKMTLGMCCIITASILLWYAQIQPHWIAASIILEFFLIVLLIPEPEKQRTPQDNQLTYVVIAILTVVAATMANEMGFLEKTKKDLGLGSIATQQPESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFIPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESEIPNLDIIGKRIEKIKEEHETSWHYDQDHPYKTWAYHGSYETKQTGSASSMVNGVVRLLTKPWDVLPTVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKNIQHLTVTEEAAVQNWLARVGRERLSRMAISGDDCVVKPLDDRFANALTALNDMGKIRKDIQQWEPSKGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIRENPWMEDKTPVESWEEIPYLGKREDQWCGSLIGLTSRATWAKNIQAAINQVRSLIGNEEYTDYMPSMKRFRREEEEAGVLW

SEQ ID NO: 3887 - protein, 3291 aa, Artificial Sequence
  derived and/or modified protein sequence (wt) from DENV-2__GU131932__SS-prME
SAGMIIMLIPTVMAFHLTTRNGEPHMIVGIQEKGKSLLFKTEDGVNMCTLMAMDLGELCEDTITYKCPLLRQNEPEDIDCWCNSTSTWVTYGTCTTTGEHRREKRSVALVPHVGMGLETRTETWMSSEGAWKHAQRIETWILRHPGFTIMAAILAYTIGTTHFQRVLIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLKEEQDKRFVCKHSMVDRGWGNGCGLFGKGGIVTCAMFTCKKNMEGKIVQPENLEYTIVVTPHSGEEHAVGNDTGKHGMEIKVTPQSSITEAELTGYGTVTMECSPRTGLDFNEMVLLQMENKAWLVHRQWFLDLPLPWLPGADKQESNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRYVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGIVTLYLGVMVQADSGCVVSWKNKELKCGSGIFITDNVHTWTEQYKFQPESPSKLASAIQKAQEEGICGIRSVTRLENLMWKQITPELNHILAENEVKLTIMTGDIKGIMQAGKRSLRPQPTELKYSWKTWGKAKMLSTESYNQTFLIDGPETAECPNTNRAWNSLEVEDYGFGVFTTNIWLKLKEKQDAFCDSKLMSAAIKDNRAVHADMGYWIESALNDTWKIEKASFIEVKNCHWPKSHTLWSNGVLESEMIIPKNLAGPVSQHNYRPGYHTQIAGPWHLGKLEMDFDFCDGTTVIVTEDCGNRGPSLRTTTASGKLITEWCCRSCTLPPLRYRGEDGCWYGMEIRPLKEKEENLVNSLVTAGHGQVDNFSLGVLGMALFLEEMLRTRVGTKHAILLVAVSFVTLITGNMSFKDLGRVVVMVGATMADDIGMGVTYLALLAAFKVRPTFAAGLLLRKLTSKELMMTTIGIVLLSQSTIPETVLELTDALALGMMVLKIVRNMEKYQLAVTIMAILCVPNAVILQNAWKVSCTILAVVSVSPLLLTSSQQKTDWIPLALTIKGLNPTAIFLTTLSRTNKKRSWPLNEAIMAVGMVSILASSLLKNDIPMTGPLVAGGLLTVCYVLTGRSADLELERATDVKWEDQAEISGSSPILSITISEDGSMSIKNEEEEQTLTILIRTGLLVISGLFPISIPITAAAWYLWEVKKQRAGVLWDVPSPPPMGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIIDKKGKVVGLYGNGVVTRSGAYVSAIAQTEKSIEDNPEIEDDIFRKRRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIIDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRRWCFDGIKNNQILEENVEVEIWTKEGERKKLKPRWLDARIYSDPLALKEFKEFAAGRKSLTLNLITEMGRLPTFMTQKTRDALDNLAVLHTAEAGGRAYNHALSELPETLETLLLLTLLATVTGGIFLFLMSGRGIGKMTLGMCCIITASILLWYAQIQPHWIAASIILEFFLIVLLIPEPEKQRTPQDNQLTYVVIAILTVVAATMANEMGFLEKTKKDLGLGSIATQQPESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKNRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFIPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESEIPNLDIIGKRIEKIKEEHETSWHYDQDHPYKTWAYHGSYETKQTGSASSMVNGVVRLLTKPWDVLPTVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKNIQHLTVTEEAAVQNWLARVGRERLSRMAISGDDCVVKPLDDRFANALTALNDMGKIRKDIQQWEPSKGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIRENPWMEDKTPVESWEEIPYLGKREDQWCGSLIGLTSRATWAKNIQAAINQVRSLIGNEEYTDYMPSMKRFRREEEEAGVLW

SEQ ID NO: 3888 - protein, 3291 aa, Artificial Sequence
  derived and/or modified protein sequence (wt) from DENV-2__GQ199892__SS-prME
TAGVIVMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKIVQPENLEYTIVITPHSGEEHAVGNDTGKHGKEIKITPQSSTTEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGAPCKIPFEITDLEKRHVLGRLITVNPIVTEKDSPVNIEAEPPFGDSYIIVGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAMVQADSGCIVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFSTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGILGMALFLEEMLRTRVGTKHAILLVALSFVTLITGNMSFRDLGRVMVMVGATMTDDIGMGVTYLALLAAFKVRPTFAAGLLLRKLTSKELMMATIGIALLSQSTLPETILELTDALALGMMALKIVRNMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVGKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGIFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRKWCFDGIKNNQILEENVEVEIWTKEGERKKLKPRWLDARIYSDPLALKEFKEFAAGRKSLTLNLITEMGRLPTFMTQKARNALDNLAVLHTAEVGGRAYTHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGFGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNVGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMETLQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKEKTPRMCTREEFTRKVRSNAALGAIFTDENKWKSAREAVEDGRFWELVDRERNLHLEGKCETCVYNMMGKREKKLGEFGKAKGSRAIWYMWLGARFLEFEALGFLNEDHWFSRGNSLSGVEGEGLHRLGYILREVGKKEGGAMYADDTAGWDTRITLEDLKNEEMVTNHMKGEHKKLAEAIFKLTYQNKVVRVQRPTPRGTVMDIISRKDQRGSGQVGTYGLNTFTNMEAQLIRQMEGEGIFKSIQHLTATEEIAVQNWLARVGRERLSRMAISGDDCVVKPIDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEGYTDYMPSMKRFRREEEEAGVLW

SEQ ID NO: 3889 - protein, 3291 aa, Artificial Sequence
  derived and/or modified protein sequence (wt) from DENV-2__JF730044__SS-prME
TAGVIIMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKEPATLRKYCIEAKLTNTTTESRCPTQGEPSLNEEQDKRFVCKHSMVDRGWGNGCGLFGKGGIVTCAMFTCKKNMEGKIVQPENLEYTIVITPHSGEEHAVGNDTGKHGKEIKITPQSSSTEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEIMDLEKRHVLGRLITVNPIVTEKDSPVNIEAEPPFGDSYIIIGVEPGQLKLNWFKKGSSIGQMFETTMRGAKRMAILGDTAWDFGSLGGVFTSMGKALHQVFGAIYGAAFSGVSWTMKILIGVIITWIGMNSRSTSLSVSLVLVGVITLYLGAMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKSFAGPVSQHNYRPGYYTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERATDVKWEDQAEISGSSPILSITISEDGSMSIKNEEEEQTLTILIRTGLLVISGLFPVSIPITAAAWYLWEVKKQRAGVLWDVPSPPPVGKAELEDGAYRIKQKGILGYSQIGAGVYKEGTFHTMWHVTRGAVLMHRGKRIEPSWADVKKDLISYGGGWKLEGEWKEGEEVQVLALEPGKNPRAVQTKPGLFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGVKNNQILEENVEVEIWTKEGERKKLKPRWLDARIYSDPLALKEFKEFAAGRKSLTLNLITEMGRLPTFMTQKARDALDNLAVLHTAEAGGRAYNHALSELPETLETLLLLTLLATVTGGIFLFLMSGKGVGKMTLGMCCIITASILLWYAQIQPHWIAASIILEFFLIVLLIPEPEKQRTPQDNQLTYVVIAILTVVAATMANEMGFLEKTKKDLGLGSIATQEPESNILDIDLRPASAWTLYAVATTFVTPMLRHSIENSSVNVSLTAIANQATVLMGLGKGWPLSKMDIGVPLLAIGCYSQVNPVTLTAALLLLVAHYAIIGPGLQAKATREAQKRAAAGIMKNPTVDGITVIDLDPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVKEVKGLTKGGPGHEEPIPMSTYGWNLVRLQSGVDVFFTPPEKCDTLLCDIGESSPNPTIEAGRTLRVLSLVENWLNNDTQFCIKVLNPYMPSVIEKMETLQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVGKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGIFKSIQHLTATEEIAVQNWLARVGRERLSRMAISGDDCVVKPLDDRFASALTALNDMGKVRKDIQQWEPSRGWNDWTQVPFCSHHFHELIMKDGRVLVVPCRNQDELIGRARISQGAGWSLKETACLGKSYAQMWSLMYFHRRDLRLAANAICSAVPSHWVPTSRTTWSIHAKHEWMTTEDMLTVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 3890 - protein, 3291 aa, Artificial Sequence
  derived and/or modified protein sequence (wt) from DENV-2__FJ639697__SS-prME
TAGVIIMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKEPATLRKYCIEAKLTNTTTESRCPTQGEPSLNEEQDKRFVCKHSMVDRGWGNGCGLFGKGGIVTCAMFTCKKNMEGKIVQPENLEYTIVITPHSGEEHAVGNDTGKHGKEIKITPQSSSTEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEIMDLEKRHVLGRLITVNPIVTEKDSPVNIEAEPPFGDSYIIIGVEPGQLKLNWFKKGSSIGQMFETTMRGAKRMAILGDTAWDFGSLGGVFTSMGKALHQVFGAIYGAAFSGVSWTMKILIGVIITWIGMNSRSTSLSVSLVLVGVITLYLGAMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKSFAGPVSQHNYRPGYYTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERATDVKWEDQAEISGSSPILSITISEDGSMSIKNEEEEQTLTILIRTGLLVISGLFPVSIPITAAAWYLWEVKKQRAGVLWDVPSPPPVGKAELEDGAYRIKQKGILGYSQIGAGVYKEGTFHTMWHVTRGAVLMHRGKRIEPSWADVKKDLISYGGGWKLEGEWKEGEEVQVLALEPGKNPRAVQTKPGLFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGVKNNQILEENVEVEIWTKEGERKKLKPRWLDARIYSDPLALKEFKEFAAGRKSLTLNLITEMGRLPTFMTQKARDALDNLAVLHTAEAGGRAYNHALSELPETLETLLLLTLLATVTGGIFLFLMSGKGVGKMTLGMCCIITASILLWYAQIQPHWIAASIILEFFLIVLLIPEPEKQRTPQDNQLTYVVIAILTVVAATMANEMGFLEKTKKDLGLGSIATQEPESNILDIDLRPASAWTLYAVATTFVTPMLRHSIENSSVNVSLTAIANQATVLMGLGKGWPLSKMDIGVPLLAIGCYSQVNPVTLTAALLLLVAHYAIIGPGLQAKATREAQKRAAAGIMKNPTVDGITVIDLDPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVKEVKGLTKGGPGHEEPIPMSTYGWNLVRLQSGVDVFFTPPEKCDTLLCDIGESSPNPTIEAGRTLRVLSLVENWLNNDTQFCIKVLNPYMPSVIEKMETLQRKYGGALVRNPLSRNSTHEMYWVSNATGNIVSSVNMISRMLINRFTMKHKKATYELDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVGKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGIFKSIQHLTVTEEIAVQNWLARVGRERLSRMAISGDDCVVKPLDDRFASALTALNDMGKVRKDIQQWEPSRGWNDWTQVPFCSHHFHELIMKDGRVLVVPCRNQDELIGRARISQGAGWSLKETACLGKSYAQMWSLMYFHRRDLRLAANAICSAVPSHWVPTSRTTWSIHAKHEWMTTEDMLTVWNRVWIQENPWMEDKTPVESWEEVPYLGKREDQWCGSLIGLTSRTTWAKNIQTAINQVRSLIGNEEYTDYMPSMKRFRREEEEAGVLW

SEQ ID NO: 3891 - protein, 3291 aa, Artificial Sequence
  derived and/or modified protein sequence (wt) from DENV-2__FJ639698__SS-prME
TAGVIIMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHAQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKEPATLRKYCIEAKLTNTTTESRCPTQGEPSLNEEQDKRFVCKHSMVDRGWGNGCGLFGKGGIVTCAMFSCKKNMEGKIVQPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEIMDLEKRHVLGRLITVNPIITEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVITLYLGAMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLKEKQDVFCDPKLMSAAIKDNRAVHADMGYWIESALNDTWKMEKASFIEVKSCHWPKSHTLWSNGVLESEMIIPKGFAGPVSQHNYRPGYYTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFSAGLLLRKLTSKELMMATIGIALLSQSTIPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERATDVKWEDQAEISGSSPILSITISEDGSMSIKNEEEEQTLTILIRTGLLVISGLFPVSIPITAAAWYLWEVKKQRAGVLWDVPSPPPVGKAELEDGAYRIKQKGILGYSQIGAGVYKEGTFHTMWHVTRGAVLMHRGKRIEPSWADVKKDLISYGGGWKLEGEWKEGEEVQVLALEPGKNPRAVQTKPGLFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGVKNNQILEENVEVEIWTKEGERKKLKPRWLDARIYSDPLALKEFKEFAAGRKSLTLNLITEMGRLPTFMTQKARDALDNLAVLHTAEVGGRAYNHALSELPETLETLLLLTLLATVTGGIFLFLMSGKGVGKMTLGMCCIITASILLWYAQIQPHWIAASIILEFFLIVLLIPEPEKQRTPQDNQLTYVVIAILTVVAATMANEMGFLEKTKKDLGLGSIATQEPESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKNEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLSLVENWLNNDTQFCIKVLNPYMPSVIEKMETLQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAKWLWKELGKKKTPRICTREEFTKKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGIFKSIQHLTVTEEVAVQNWLARVGRERLSRMAISGDDCVVKPLDDRFASALTALNDMGKVRKDIQQWEPSRGWNDWTQVPFCSHHFHELIMKDGRVLVVPCRNQDELIGRARISQGAGWSLKETACLGKSYAQMWSLMYFHRRDLRLAANAICSAVPSHWVPTSRTTWSIHAKHEWMTTEDMLTVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 3892 - protein, 3291 aa, Artificial Sequence
  derived and/or modified protein sequence (wt) from DENV-2__FJ639699__SS-prME
TAGVIIMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHAQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKEPATLRKYCIEAKLTNTTTESRCPTQGEPSLNEEQDKRFVCKHSMVDRGWGNGCGLFGKGGIVTCAMFSCKKNMEGKIVQPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEIMDLEKRHVLGRLITVNPIITEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVITLYLGAMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLKEKQDVFCDSKLMSAAIKDNRAVHADMGYWIESALNDTWKMEKASFIEVKSCHWPKSHTLWSNGVLESEMIIPKGFAGPVSQHNYRPGYYTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMATIGIALLSQSTIPETILELTDALALGMMILKIVRNMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERATDVKWEDQAEISGSSPILSITISEDGSMSIKNEEEEQTLTILIRTGLLVISGLFPVSIPITAAAWYLWEVKKQRAGVLWDVPSPPPVGKAELEDGAYRIKQKGILGYSQIGAGVYKEGTFHTMWHVTRGAVLMHRGKRIEPSWADVKKDLISYGGGWKLEGEWKEGEEVQVLALEPGKNPRAVQTKPGLFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGVKNNQILEENVEVEIWTKEGERKKLKPRWLDARIYSDPLALKEFKEFAAGRKSLTLNLITEMGRLPTFMTQKARDALDNLAVLHTAEVGGRAYNHALSELPETLETLLLLTLLATVTGGIFLFLMSGKGVGKMTLGMCCIITASILLWYAQIQPHWIAASIILEFFLIVLLIPEPEKQRTPQDNQLTYVVIAILTVVAATMANEMGFLEKTKKDLGLGSIATQEPESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKNEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLSLVENWLNNDTQFCIKVLNPYMPSVIEKMETLQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAKWLWKELGKKKTPRICTREEFTKKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGIFKSIQYLTVTEEVAVQNWLARVGRERLSRMAISGDDCVVKPLDDRFASALTALNDMGKVRKDIQQWEPSRGWNDWTQVPFCSHHFHELIMKDGRVLVVPCRNQDELIGRARISQGAGWSLKETACLGKSYAQMWSLMYFHRRDLRLAANAICSAVPSHWVPTSRTTWSIHAKHEWMTTEDMLTVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 3893 - protein, 3291 aa, Artificial Sequence
  derived and/or modified protein sequence (wt) from DENV-2__FJ639700__SS-prME
TAGVIIMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHAQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKEPATLRKYCIEAKLTNTTTESRCPTQGEPSLNEEQDKRFVCKHSMVDRGWGNGCGLFGKGGIVTCAMFSCKKNMEGKIVQPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEIMDLEKRHVLGRLITVNPIITEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVITLYLGAMVQADSGCVVSWKNKELKCGSGIFITDNVHTWTEQYKFQPESPSKLASAIQKAHEEGICGIRSVTRLENLMWKQITPELNHILSENEAKLTIMTGDIKGIMQAGKRSLRPQPTELKYSWKTWGKAKMLSTESHNQTFLIDGPETAECPNTNRAWNSLEVEDYGFGVFTTNIWLKLKEKQDVFCDSKLMSAAIKDNRAVHADMGYWIESALNDTWKMEKASFIEVKSCHWPKSHTLWSNGVLESEMIIPKGFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMATIGIALLSQSTIPETILELTDALALGMMILKIVRNMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERATDVKWEDQAEISGSSPILSITISEDGSMSIKNEEEEQTLTILIRTGLLVISGLFPVSIPITAAAWYLWEVKKQRAGVLWDVPSPPPVGKAELEDGAYRIKQKGILGYSQIGAGVYKEGTFHTMWHVTRGAVLMHRGKRIEPSWADVKKDLISYGGGWKLEGEWKEGEEVQVLALEPGKNPRAVQTKPGLFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGVKNNQILEENVEVEIWTKEGERKKLKPRWLDARIYSDPLALKEFKEFAAGRKSLTLNLITEMGRLPTFMTQKARDALDNLAVLHTAEVGGRAYNHALSELPETLETLLLLTLLATVTGGIFLFLMSGKGVGKMTLGMCCIITASILLWYAQIQPHWIAASIILEFFLIVLLIPEPEKQRTPQDNQLTYVVIAILTVVAATMANEMGFLEKTKKDLGLGSIATQEPESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKNEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLSLVENWLNNDTQFCIKVLNPYMPSVIEKMETLQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAKWLWKELGKKKTPRICTREEFTKKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRKDQRGSGQVGTYGLNTFTNMEAQLIRQMEGEGIFKSIQYLTVTEEVAVQNWLARVGRERLSRMAISGDDCVVKPLDDRFASALTALNDMGKVRKDIQQWEPSRGWNDWTQVPFCSHHFHELIMKDGRVLVVPCRNQDELIGRARISQGAGWSLKETACLGKSYAQMWSLMYFHRRDLRLAANAICSAVPSHWVPTSRTTWSIHAKHEWMTTEDMLTVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 3894 - protein, 3291 aa, Artificial Sequence
  derived and/or modified protein sequence (wt) from DENV-2__GQ868620__SS-prME
SAGMIIMLIPTVMAFHLTTRNGEPHMIVGIQEKGKSLLFKTEDGVNMCTLMAMDLGELCEDTITYKCPLLRQNEPEDIDCWCNSTSTWVTYGTCTTTGEHRREKRSVALVPHVGMGLETRTETWMSSEGAWKHAQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLKEEQDKRFVCKHSMVDRGWGNGCGLFGKGGIVTCAMFTCKKNMEGKIVQPENLEYTIVVTPHSGEEHAVGNDTGKHGKEIKVTPQSSITEAELTGYGTVTMECSPRTGLDFNEMVLLQMENKAWLVHRQWFLDLPLPWLPGADKQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRYVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGIVTLYLGVMVQADSGCVVSWKNKELKCGSGIFITDNVHTWTEQYKFQPESPSKLASAIQKAQEEGICGIRSVTRLENLMWKQITPELNHILAENEVKLTIMTGDIKGIMQAGKRSLRPQPTELKYSWKTWGKAKMLSTESHNQTFLIDGPETAECPNTNRAWNSLEVEDYGFGVFTTNIWLKLKEKQDAFCDSKLMSAAIKDNRAVHADMGYWIESALNDTWKIEKASFIEVKNCHWPKSHTLWSNGVLESEMIIPKNLAGPVSQHNYRPGYHTQIAGPWHLGKLEMDFDFCDGTTVIVTEDCGNRGPSLRTTTASGKLITEWCCRSCTLPPLRYRGEDGCWYGMEIRPLKEKEENLVNSLVTAGHGQVDNFSLGVLGMALFLEEMLRTRVGTKHAILLVAVSFVTLITGNMSFKDLGRVVVMVGATMTDDIGMGVTYLALLAAFKVRPTFAAGLLLRKLTSKELMMTTIGIVLLSQSTIPETILELTDALALGMMVLKIVRNMEKYQLAVTIMAILCVPNAVILQNAWKVSCTILAVVSVSPLLLTSSQQKTDWIPLALTIKGLNPTAIFLTTLSRTNKKRSWPLNEAIMAVGMVSILASSLLKNDIPMTGPLVAGGLLTVCYVLTGRSADLELERATDVKWEDQAEISGSSPILSITISEDGSMSIKNEEEEQTLTILIRTGLLVISGLFPVSIPITAAAWYLWEVKKQRAGVLWDVPSPPPMGKAELEDGAYRIKQKGILGYSQIGAGVYKEGTFHTMWHVTRGAVLMHKGKRIEPSWADVKKDLISYGGGWKLEGEWKEGEEVQVLALEPGKNPRVVQTKPGLFKTNTGTIGAVSLDFSPGTSGSPIIDKKGKVVGLYGNGVVTRSGAYVSAIAQTEKSIEDNPEIEDDIFRKRRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIIDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRRWCFDGIKNNQILEENVEVEIWTKEGERKKLKPRWLDARIYSDPLALKEFKEFAAGRKSLTLNLITEMGRLPTFMTQKTRDALDNLAVLHTAEAGGRAYNHALSELPETLETLLLLTLLATVTGGIFLFLMSGRGIGKMTLGMCCIITASILLWYAQIQPHWIAASIILEFFLIVLLIPEPEKQRTPQDNQLTYVVIAILTVVAATMANEMGFLEKTKKDLGLGSIATQQPESNILDIDLRPASAWTLYAVATTFVTPMLRHSIENSSVNVSLTAIANQATVLMGLGKGWPLSKMDIGVPLLAIGCYSQVNPITLTAALLLLIAHYAIIGPGLQAKATREAQKRAAAGIMKNPTVDGITVIDLDPIPYDPKFEKQLGQVMLLILCVTQVLMMRTTWALCEALTLATGPISTLWEGNPGRFWNTTIAVSMANIFRGSYLAGAGLLFSIMKNANNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFIPPEKCDTLLCDIGESSPNPTVEAGRTLRVLNLVENWLNNDTQFCIKVLNPYMPSVIEKMEALQRKYGGALVRNPLSRNSTHEMYWVSNASGNIVSSVNMISRMLINRFTMRHKKATYEPDVDLGSGTRNIGIESEIPNLDIIGKRIEKIKQEHETSWYYDQDHPYKTWAYHGSYETKQTGSASSMVNGVVRLLTKPWDVLPTVTQMAMTDTTPFGQQRVFKEKVDTRTQEPKEGTKKLMKITAEWLWKELGKKKTPRMCTREEFIRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFENIQHLTVTEEVAVQNWLARVGRERLSRMAISGDDCVVKPLDDRFANALTALNDMGKIRKDIQQWEPSKGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIRENPWMEDKTPVESWEEIPYLGKREDQWCGSLIGLTSRATWAKNIQAAINQVRSLIGNEEYTDYMPSMKRFRREEEEAGVLW

SEQ ID NO: 3895 - protein, 3291 aa, Artificial Sequence
  derived and/or modified protein sequence (wt) from DENV-2__FJ639702__SS-prME
TAGVIIMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKEPATLRKYCIEAKLTNTTTESRCPTQGEPSLNEEQDKRFVCKHSMVDRGWGNGCGLFGKGGIVTCAMFTCKKNMEGKIVQPENLEYTIVITPHSGEEHAVGNDTGKHGKEIKITPQSSSTEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEIMDLEKRHVLGRLITVNPIVTEKDSPVNIEAEPPFGDSYIIIGVEPGQLKLNWFKKGSSIGQMFETTMRGAKRMAILGDTAWDFGSLGGVFTSMGKALHQVFGAIYGAAFSGVSWTMKILIGVIITWIGMNSRSTSLSVSLVLVGVITLYLGAMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKSFAGPVSQHNYRPGYYTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSLVTLITGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERATDVKWEDQAEISGSSPILSITISEDGSMSIKNEEEEQTLTILIRTGLLVISGLFPVSIPITAAAWYLWEVKKQRAGVLWDVPSPPPVGKAELEDGAYRIKQKGILGYSQIGAGVYKEGTFHTMWHVTRGAVLMHRGKRIEPSWADVKKDLISYGGGWKLEGEWKEGEEVQVLALEPGKNPRAVQTKPGLFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSKDPFPQSNAPIMDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGVKNNQILEENVEVEIWTKEGERKKLKPRWLDARIYSDPLALKEFKEFAAGRKSLTLNLITEMGRLPTFMTQKARDALDNLAVLHTAEAGGRAYNHALSELPETLETLLLLTLLATVTGGVFLFLMSGKGVGKMTLGMCCIITASILLWYAQIQPHWIAASIILEFFLIVLLIPEPEKQRTPQDNQLTYVVIAILTVVAATMANEMGFLEKTKKDLGLGSIATQEPESNILDIDLRPASAWTLYAVATTFVTPMLRHSIENSSVNVSLTAIANQATVLMGLGKGWPLSKMDIGVPLLAIGCYSQVNPVTLTAALLLLVAHYAIIGPGLQAKATREAQKRAAAGIMKNPTVDGITVIDLDPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVKEVKGLTKGGPGHEEPIPMSTYGWNLVRLQSGVDVFFTPPEKCDTLLCDIGESSPNPTIEAGRTLRVLSLVENWLNNDTQFCIKVLNPYMPSVIEKMETLQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVGKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGIFKSIQHLTATEEIAVQNWLARVGRERLSRMAISGDDCVVKPLDDRFASALTALNDMGKVRKDIQQWEPSRGWNDWTQVPFCSHHFHELIMKDGRVLVVPCRNQDELIGRARISQGAGWSLKETACLGKSYAQMWSLMYFHRRDLRLAANAICSAVPSHWVPTSRTTWSIHAKHEWMTTEDMLTVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 3896 - protein, 3291 aa, Artificial Sequence
  derived and/or modified protein sequence (wt) from DENV-2__GQ868621__SS-prME
SAGMIIMLIPTVMAFHLTTRNGEPHMIVGIQEKGKSLLFKTEDGVNMCTLMAMDLGELCEDTITYKCPLLRQNEPEDIDCWCNSTSTWVTYGTCTTTGEHRREKRSVALVPHVGMGLETRTETWMSSEGAWKHAQRIETWILRHPGFTIMAAILAYTIGTTHFQRVLIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLKEEQDKRFVCKHSMVDRGWGNGCGLFGKGGIVTCAMFTCKKNMEGKIVQPENLEYTIVVTPHSGEEHAVGNDTGKHGKEIKVTPQSSITEAELTGYGTVTMECSPRTGLDFNEMVLLQMENKAWLVHRQWFLDLPLPWLPGADKQESNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRYILGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGIVTLYLGVMVQADSGCVVSWKNKELKCGSGIFITDNVHTWTEQYKFQPESPSKLASAIQKAQEEGICGIRSVTRLENLMWKQITPELNHILAENEVKLTIMTGDIKGIMQAGKRSLRPQPTELKYSWKTWGKAKMLSTESYNQTFLIDGPETAECPNTNRAWNSLEVEDYGFGVFTTNIWLKLKEKQDAFCDSKLMSAAIKDNRAVHADMGYWIESALNDTWKIEKASFIEVKNCHWPKSHTLWSNGVLESEMIIPKNLAGPVSQHNYRPGYHTQIAGPWHLGKLEMDFDFCDGTTVIVTEDCGNRGPSLRTTTASGKLITEWCCRSCTLPPLRYRGEDGCWYGMEIRPLKEKEENLVNSLVTAGHGQVDNFSLGVLGMALFLEEMLRTRVGTKHAILLVAVSFMTLITGNMSFKDLGRVVVMVGATMADDIGMGVTYLALLAAFKVRPTFAAGLLLRKLTSKELMMTTIGIVLLSQSTIPETVLELTDALALGMMVLKIVRNMEKYQLAVTIMAILCVPNAVILQNAWKVSCTILAVVSVSPLLLTSSQQKTDWIPLALTIKGLNPTAIFLTTLSRTNKKRSWPLNEAIMAVGMVSILASSLLKNDIPMTGPLVAGGLLTVCYVLTGRSADLELERATDVKWEDQAEISGSSPILSITISEDGSMSIKNEEEEHTLTILIRTGLLVISGLFPISIPITAAAWYLWEVKKQRAGVLWDVPSPPPMGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIIDKKGKVVGLYGNGVVTRSGAYVSAIAQTEKSIEDNPEIEDDIFRKRRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIIDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRRWCFDGIKNNQILEENVEVEIWTKEGERKKLKPRWLDARIYSDPLALKEFKEFAAGRKSLTLNLITEMGRLPTFMTQKTRDALDNLAVLHTAEAGGRAYNHALSELPETLETLLLLTLLATVTGGIFLFLMSGRGIGKMTLGMCCIITASILLWYAQIQPHWIAASIILEFFLIVLLIPEPEKQRTPQDNQLTYVVIAILTVVAATMANEMGFLEKTKKDLGLGSIATQQPESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFIPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESEVPNLDIIGKRIEKIKQEHETSWHYDQDHPYKTWAYHGSYETKQTGSASSMVNGVVRLLTKPWDVLPTVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKNIQHLTVTEEVAVQNWLARVGRERLSRMAISGDDCVVKPLDDRFANALTALNDMGKIRKDIQQWEPSKGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIRENPWMEDKTPVESWEEIPYLGKREDQWCGSLIGLTSRATWAKNIQAAINQVRSLIGNEEYTDYMPSMKRFRREEEEAGVLW

SEQ ID NO: 3897 - protein, 3291 aa, Artificial Sequence
  derived and/or modified protein sequence (wt) from DENV-2__FJ639704__SS-prME
SAGMIIMLIPTVVAFHLTTRNGEPHMIVGIQEKGKSLLFKTEDGVNMCTLMAMDLGELCEDTITYKCPLLRQNEPEDIDCWCNSTSTWVTYGTCTTTGEHRREKRSVALVPHVGMGLETRTETWMSSEGAWKHAQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLKEEQDKRFVCKHSMVDRGWGNGCGLFGKGGIVTCAMFTCKKNMEGKIVQPENLEYTIVVTPHSGEEHAVGNDTGKHGKEIKVTPQSSITEAELTGYGTVTMECSPRTGLDFNEMVLLQMENKAWLVHRQWFLDLPLPWLPGADKQESNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRYVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGIVTLYLGVMVQADSGCVVSWKNKELKCGSGIFITDNVHTWTEQYKFQPESPSKLASAIQKAQEEGICGIRSVTRLENLMWKQITPELNHILAENEVKLTIMTGDIKGIMQAGKRSLRPQPTELKYSWKTWGKTKMLSTESYNQTFLIDGPETTECPNTNRAWNSLEVEDYGFGVFTTNIWLKLKEKQDAFCDSKLMSAAIKDNRAVHADMGYWIESALNDTWKIEKASFIEVKNCHWPKSHTLWSNGVLESEMIIPKNLAGPVSQHNYRPGYHTQIAGPWHLGKLEMDFDFCDGTTVIVTEDCGNRGPSLRTTTASGKLITEWCCRSCTLPPLRYRGEDGCWYGMEIRPLKEKEENLVNSLVTAGHGQVDNFSLGVLGMALFLEEMLRTRVGTKHAILLVAVSFVTLITGNMSFKDLGRVVVMVGATMADDIGMGVTYLALLAAFKVRPTFAAGLLLRKLTSKELMMTTIGIVLLSQSTIPETILELTDALALGMMVLKIVRNMEKYQLAVTIMAILCVPNAVILQNAWKVSCTILAVVSVSPLLLTSSQQKADWIPLALTIKGLNPTAIFLTTLSRTNKKRSWPLNEAIMAVGMVSILASSLLKNDIPMTGPLVAGGLLTVCYVLTGRSADLELERATDVKWEEQAEISGSSPILSITISEDGSMSIKNEEEEQTLTILIRTGLLVISGLFPISIPITAAAWYLWEVKKQRAGVLWDVPSPPPMGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIIDKKGKVVGLYGNGVVTRSGAYVSAIAQTEKSIEDNPEIEDDIFRKRRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIIDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRRWCFDGIKNNQILEENVEVEIWTKEGERKKLKPRWLDARIYSDPLALKEFKEFAAGRKSLTLNLITEMGRLPTFMTQKTRDALDNLAVLHTAEAGGRAYNHALSELPETLETLLLLTLLATVTGGIFLFLMSGRGIGKMTLGMCCIITASILLWYAQIQPHWIAASIILEFFLIVLLIPEPEKQRTPQDNQLTYVVIAILTVVAATMANEMGFLEKTKKDLGLGSIATQQPESNILDIDLRPASAWTLYAVATTFITPMLRHSIENSSVNISLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVKEVKGLTKGGPGHEEPIPMSTYGWNLVRLQSGVDVFFIPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESEVPNLDIIGKRIEKIKQEHETSWHYDQDHPYKTWAYHGSYETKQTGSASSMVNGVVRLLTKPWDVLPTVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKNIQHLTVTEEVAVQNWLARVGRERLSRMAISGDDCVVKPLDDRFANALTALNDMGKIRKDIQQWEPSKGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIRENPWMEDKTPVESWEEIPYLGKREDQWCGSLIGLTSRATWAKNIQAAINQVRSLIGNEEYTDYMPSMKRFRREEEEAGVLW

SEQ ID NO: 3898 - protein, 3291 aa, Artificial Sequence
  derived and/or modified protein sequence (wt) from DENV-2__GQ868622__SS-prME
SAGMIIMLIPTVMAFHLTTRNGEPHMIVGIQEKGKSLLFKTEDGVNMCTLMAMDLGELCEDTITYKCPLLRQNEPEDIDCWCNSTSTWVTYGTCTTTGEHRREKRSVALVPHVGMGLETRTETWMSSEGAWKHAQRIETWILRHPGFTIMAAILAYTIGTTHFQRALIFILLTAVAPSMTMRCIGISNRDFVEGVSGGSWVDIVLEHGSCVTTMAKNKPTLDFELIKTEARQPATLRKYCIEAKLTNTTTESRCPTQGEPSLKEEQDKRFVCKHSMVDRGWGNGCGLFGKGGIVTCAMFTCKKNMEGKIVQPENLEYTIVVTPHSGEEHAVGNDTGKHGKEIKVTPQSSITEAELTGYGTVTMECSPRTGLDFNEMVLLQMENKAWLVHRQWFLDLPLPWLPGADKQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRYVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGIVTLYLGVMVQADSGCVVSWKNKELKCGSGIFITDNVHTWTEQYKFQPESPSKLASAIQKAQEEGICGIRSVTRLENLMWKQITPELNHILAENEVKLTIMTGDIKGIMQAGKRSLRPQPTELKYSWKTWGKAKMLSTESHNQTFLIDGPETAECPNTNRAWNSLEVEDYGFGVFTTNIWLKLKEKQDAFCDSKLMSAAIKDNRAVHADMGYWIESALNDTWKIEKASFIEVKNCHWPKSHTLWSNGVLESEMIIPKNLAGPVSQHNYRPGYHTQIAGPWHLGKLEMDFDFCDGTTVIVTEDCGNRGPSLRTTTASGKLITEWCCRSCTLPPLRYRGEDGCWYGMEIRPLKEKEENLVNSLVTAGHGQVDNFSLGVLGMALFLEEMLRTRVGTKHAILLVAVSFVTLITGNMSFKDLGRVVVMVGATMTDDIGMGVTYLALLAAFKVRPTFAAGLLLRKLTSKELMMTTIGIVLLSQSTIPETILELTDALALGMMVLKIVRDMEKYQLAVTIMAILCVPNAVILQNAWKVSCTILAVVSVSPLLLTSSQQKTDWIPLALTIKGLNPTAIFLTTLSRTNKKRSWPLNEAIMAVGMVSILASSLLKNDIPMTGPLVAGGLLTVCYVLTGRSADLELERATDVKWEDQAEISGSSPILSITISEDGSMSIKNEEEEQTLTILIRTGLLVISGLFPVSIPITAAAWYLWEVKKQRAGVLWDVPSPPPMGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIIDKKGKVVGLYGNGVVTRSGAYVSAIAQTEKSIEDNPEIEDDIFRKRRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIIDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRRWCFDGIKNNQILEENVEVEIWTKEGERKKLKPRWLDARIYSDPLALKEFKEFAAGRKSLTLNLITEMGRLPTFMTQKTRDALDNLAVLHTAEAGGRAYNHALSELPETLETLLLLTLLATVTGGIFLFLMSGRGIGKMTLGMCCIITASILLWYAQIQPHWIAASIILEFFLIVLLIPEPEKQRTPQDNQLTYVVIAILTVVAATMANEMGFLEKTKKDLGLGSIATQQPESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQTYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFIPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESEIPNLDIIGKRIEKIKQEHETSWHYDQDHPYKTWAYHGSYETKQTGSASSMVNGVVRLLTKPWDVLPTVTQMAMTDTTPFGQQRVFKEKVDTRTQEPKEGTKKLMKITAEWLWKELGKKKTPRMCTREEFTRKVRSNAALGAIFTDENKWKSAREAVEDRRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKNIQHLTATEEVAVQNWLARVGRERLSRMAISGDDCVVKPLDDRFANALTALNDMGKIRKDIQQWEPSKGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIRENPWMEDKTPVESWEEIPYLGKREDQWCGSLIGLTSRATWAKNIQAAINQVRSLIGNEEYTDYMPSMKRFRREEEEAGVLW

SEQ ID NO: 3899 - protein, 3291 aa, Artificial Sequence
  derived and/or modified protein sequence (wt) from DENV-2__FJ639705__SS-prME
SAGMIIMLIPTVMAFHLTTRNGEPHMIVGIQEKGKSLLFKTEDGVNMCTLMAMDLGELCEDTITYKCPLLRQNEPEDIDCWCNSTSTWVTYGTCTTTGEHRREKRSVALVPHVGMGLETRTETWMSSEGAWKHAQRIETWILRHPGFTIMAAILAYTIGTTHFQRALIFILLTAVAPSMTMRCIGISNRDFVEGVSGGSWVDIVLEHGSCVTTMAKNKPTLDFELIKTEARQPATLRKYCIEAKLTNTTTESRCPTQGEPSLKEEQDKRFVCKHSMVDRGWGNGCGLFGKGGIVTCAMFTCKKNMEGKIVQPENLEYTIVVTPHSGEEHAVGNDTGKHGKEIKVTPQSSITEAELTGYGTVTMECSPRTGLDFNEMVLLQMENKAWLVHRQWFLDLPLPWLPGADKQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRYVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGIVTLYLGVMVQADSGCVVSWKNKELKCGSGIFITDNVHTWTEQYKFQPESPSKLASAIQKAQEEGICGIRSVTRLENLMWKQITPELNHILAENEVKLTIMTGDIKGIMQAGKRSLRPQPTELKYSWKTWGKAKMLSTESHNQTFLIDGPETAECPNTNRAWNSLEVEDYGFGVFTTNIWLKLKEKQDAFCDSKLMSAAIKDNRAVHADMGYWIESALNDTWKIEKASFIEVKNCHWPKSHTLWSNGVLESEMIIPKNLAGPVSQHNYRPGYHTQIAGPWHLGKLEMDFDFCDGTTVIVTEDCGNRGPSLRTTTASGKLITEWCCRSCTLPPLRYRGEDGCWYGMEIRPLKEKEENLVNSLVTAGHGQVDNFSLGVLGMALFLEEMLRTRVGTKHAILLVAVSFVTLITGNMSFKDLGRVVVMVGATMTDDIGMGVTYLALLAAFKVRPTFAAGLLLRKLTSKELMMTTIGIVLLSQSTIPETILELTDALALGMMVLKIVRDMEKYQLAVTIMAILCVPNAVILQNAWKVSCTILAVVSVSPLLLTSSQQKTDWIPLALTIKGLNPTAIFLTTLSRTNKKRSWPLNEAIMAVGMVSILASSLLKNDIPMTGPLVAGGLLTVCYVLTGRSADLELERATDVKWEDQAEISGSSPILSITISEDGSMSIKNEEEEQTLTILIRTGLLVISGLFPVSIPITAAAWYLWEVKKQRAGVLWDVPSPPPMGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIIDKKGKVVGLYGNGVVTRSGAYVSAIAQTEKSIEDNPEIEDDIFRKRRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIIDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRRWCFDGIKNNQILEENVEVEIWTKEGERKKLKPRWLDARIYSDPLALKEFKEFAAGRKSLTLNLITEMGRLPTFMTQKTRDALDNLAVLHTAEAGGRAYNHALSELPETLETLLLLTLLATVTGGIFLFLMSGRGIGKMTLGMCCIITASILLWYAQIQPHWIAASIILEFFLIVLLIPEPEKQRTPQDNQLTYVVIAILTVVAATMANEMGFLEKTKKDLGLGSIATQQPESNILDIDLRPASAWTLYAVATTFVTPMLRHSIENSSVNVSLTAIANQATVLMGLGKGWPLSKMDIGVPLLAIGCYSQVNPITLTAALLSLVAHYAIIGPGLQAKATREAQKRAAAGIMKNPTVDGITVIDLDPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQTYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFIPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESEIPNLDIIGKRIEKIKQEHETSWHYDQDHPYKTWAYHGSYETKQTGSASSMVNGVVRLLTKPWDVLPTVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKNIQHLTATEEVAVQNWLARVGRERLSRMAISGDDCVVKPLDDRFANALTALNDMGKIRKDIQQWEPSKGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIRENPWMEDKTPVESWEEIPYLGKREDQWCGSLIGLTSRATWAKNIQAAINQVRSLIGNEEYTDYMPSMKRFRREEEEAGVLW

SEQ ID NO: 3900 - protein, 3291 aa, Artificial Sequence
  derived and/or modified protein sequence (wt) from DENV-2__FJ639706__SS-prME
SAGMIIMLIPTVMAFHLTTRNGEPHMIVGIQEKGKSLLFKTEDGVNMCTLMAMDLGELCEDTITYKCPLLRQNEPEDIDCWCNSTSTWVTYGTCTTTGEHRREKRSVALVPHVGMGLETRTETWMSSEGAWKHAQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLKEEQDKRFVCKHSMVDRGWGNGCGLFGKGGIVTCAMFTCKKNMEGKIVQPENLEYTIVVTPHSGEEHAVGNDTGKHGKEIKVTPQSSITEAELTGYGTVTMECSPRTGLDFNEMVLLQMENKAWLVHRQWFLDLPLPWLPGADKQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRYVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGIVTLYLGVMVQADSGCVVSWKNKELKCGSGIFITDNVHTWTEQYKFQPESPSKLASAIQKAQEEGICGIRSVTRLENLMWKQITPELNHILAENEVKLTIMTGDIKGIMQAGKRSLRPQPTELKYSWKTWGKAKMLSTESHNQTFLIDGPETAECPNTNRAWNSLEVEDYGFGVFTTNIWLKLKEKQDAFCDSKLMSAAIKDNRAVHADMGYWIESALNDTWKIEKASFIEVKNCHWPKSHTLWSNGVLESEMIIPKNLAGPVSQHNYRPGYHTQIAGPWHLGKLEMDFDFCDGTTVIVTEDCGNRGPSLRTTTASGKLITEWCCRSCTLPPLRYRGEDGCWYGMEIRPLKEKEENLVNSLVTAGHGQVDNFSLGVLGMALFLEEMLRTRVGTKHAILLVAVSFVTLITGNMSFKDLGRVVVMVGATMTDDIGMGVTYLALLAAFKVRPTFAAGLLLRKLTSKELMMTTIGIALLSQSTIPETILELTDALALGMMVLKIVRDMEKYQLAVTIMAILCVPNAVILQNAWKVSCTILAVVSVSPLLLTSSQQKTDWIPLALTIKGLNPTAIFLTTLSRTNKKRSWPLNEAIMAVGMVSILASSLLKNDIPMTGPLVAGGLLTVCYVLTGRSADLELERATDVKWEDQAEISGSSPILSITISEDGSMSIKNEEEEQTLTILIRTGLLVISGLFPVSIPITAAAWYLWEVKKQRAGVLWDVPSPPPMGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIIDKKGKVVGLYGNGVVTRSGAYVSAIAQTEKSIEDNPEIEDDIFRKRRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIIDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRRWCFDGIKNNQILEENVEVEIWTKEGERKKLKPRWLDARIYSDPLALKEFKEFAAGRKSLTLNLITEMGRLPTFMTQKTRDALDNLAVLHTAEAGGRAYNHALSELPETLETLLLLTLLATVTGGIFLFLMSGRGIGKMTLGMCCIITASILLWYAQIQPHWIAASIILEFFLIVLLIPEPEKQRTPQDNQLTYVVIAILTVVAATMANEMGFLEKTKKDLGLGSIATQQPESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQTYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFIPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESEIPNLDIIGKRIEKIKQEHETSWHYDQDHPYKTWAYHGSYETKQTGSASSMVNGVVRLLTKPWDVLPTVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRKDQRGSGQVGTYGLNTFTNMEAQLIRQMEGEGVFKNIQHLTATEEVAVQNWLARVGRERLSRMAISGDDCVVKPLDDRFANALTALNDMGKIRKDIQQWEPSKGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIRENPWMEDKTPVESWEEIPYLGKREDQWCGSLIGLTSRATWAKNIQAAINQVRSLIGNEEYTDYMPSMKRFRREEEEAGVLW

SEQ ID NO: 3901 - protein, 3291 aa, Artificial Sequence
  derived and/or modified protein sequence (wt) from DENV-2__FJ639707__SS-prME
SAGMIIMLIPTVMAFHLTTRNGEPHMIVGIQEKGKSLLFKTEDGVNMCTLMAMDLGELCEDTITYKCPLLRQNEPEDIDCWCNSTSTWVTYGTCTTTGEHRREKRSVALVPHVGMGLETRTETWMSSEGAWKHAQRIETWILRHPGFTIMAAILAYTIGTTHFQRVLIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLKEEQDKRFVCKHSMVDRGWGNGCGLFGKGGIVTCAMFTCKKNMEGKIVQPENLEYTIVVTPHSGEEHAVGNDTGKHGKEIKVTPQSSITEAELTGYGTVTMECSPRTGLDFNEMVLLQMENKAWLVHRQWFLDLPLPWLPGADKQESNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRYILGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGIVTLYLGVMVQADSGCVVSWKNKELKCGSGIFITDNVHTWTEQYKFQPESPSKLASAIQKAQEEGICGIRSVTRLENLMWKQITPELNHILAENEVKLTIMTGDIKGIMQAGKRSLRPQPTELKYSWKTWGKAKMLSTESYNQTFLIDGPETTECPNTNRAWNSLEVEDYGFGVFTTNIWLKLKEKQDAFCDSKLMSAAIKDNRAVHADMGYWIESALNDTWKIEKASFIEVKNCHWPKSHTLWSNGVLESEMIIPKNLAGPVSQHNYRPGYHTQIAGPWHLGKLEMDFDFCDGTTVIVTEDCGNRGPSLRTTTASGKLITEWCCRSCTLPPLRYRGEDGCWYGMEIRPLKEKEENLVNSLVTAGHGQVDNFSLGVLGMALFLEEMLRTRVGTKHAILLVAVSFMTLITGNMSFKDLGRVVVMVGATMADDIGMGVTYLALLAAFKVRPTFAAGLLLRKLTSKELMMTTIGIVLLSQSTIPETVLELTDALALGMMVLKIVRNMEKYQLAVTIMAILCVPNAVILQNAWKVSCTILAVVSVSPLLLTSSQQKTDWIPLALTIKGLNPTAIFLTTLSRTNKKRSWPLNEAIMAVGMVSILASSLLKNDIPMTGPLAAGGLLTVCYVLTGRSADLELERATDVKWEDQAEISGSSPILSITISEDGSMSIKNEEEEQTLTILIRTGLLVISGLFPISIPITAAAWYLWEVKKQRAGVLWDVPSPPPMGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIIDKKGKVVGLYGNGVVTRSGAYVSAIAQTEKSIEDNPEIEDDIFRKRRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIIDEEREIPERSWNSGHEWVTDFKGKTVWFVPSIKAGNDIAACLRKNGKKVIQLSRKTFDSEYAKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRRWCFDGIKNNQILEENVEVEIWTKEGERKKLKPRWLDSRIYSDPLALKEFKEFAAGRKSLTLNLITEMGRLPTFMTQKTRDALDNLAVLHTAEAGGRAYNHALSELPETLETLLLLTLLATVTGGIFLFLMSGRGIGKMTLGMCCIITASILLWYAQIQPHWIAASIILEFFLIVLLIPEPEKQRTPQDNQLTYVVIAILTVVAATMANEMGFLEKTKKDLGLGSIATQQPESNILDIDLRPASAWTLYAVATTFVTPMLRHSIENSSVNVSLTAIANQATVLVGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFIPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESEVPNLDIIGKRIEKIKQEHETSWHYDQDHPYKTWAYHGSYETKQTGSASSMVNGVVRLLTKPWDVLPTVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKNIQHLTVTEEVAVQNWLARVGRERLSRMAISGDDCVVKPLDDRFANALTALNDMGKIRKDIQQWEPSKGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIRENPWMEDKTPVESWEEIPYLGKREDQWCGSLIGLTSRATWAKNIQAAINQVRSLIGNEEYTDYMPSMKRFRREEEEAGVLW

SEQ ID NO: 3902 - protein, 3291 aa, Artificial Sequence
  derived and/or modified protein sequence (wt) from DENV-2__FJ639708__SS-prME
SAGMIIMLIPTVMAFHLTTRNGEPHMIVGIQEKGKSLLFKTEDGVNMCTLMAMDLGELCEDTITYKCPLLRQNEPEDIDCWCNSTSTWVTYGTCTTTGEHRREKRSVALVPHVGMGLETRTETWMSSEGAWKHAQRIETWILRHPGFTIMAAILAYTIGTTHFQRVLIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLKEEQDKRFVCKHSMVDRGWGNGCGLFGKGGIVTCAMFTCKKNMEGKIVQPENLEYTIVVTPHSGEEHAVGNDTGKHGKEIKVTPQSSITEAELTGYGTVTMECSPRTGLDFNEMVLLQMENKAWLVHRQWFLDLPLPWLPGADKQESNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRYILGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGIVTLYLGVMVQADSGCVVSWKNKELKCGSGIFITDNVHTWTEQYKFQPESPSKLASAIQKAQEEGICGIRSVTRLENLMWKQITPELNHILAENEVKLTIMTGDIKGIMQAGKRSLRPQPTELKYSWKTWGKAKMLSTESYNQTFLIDGPETAECPNTNRAWNSLEVEDYGFGVFTTNIWLKLKEKQDAFCDSKLMSAAIKDNRAVHADMGYWIESALNDTWKIEKASFIEVKNCHWPKSHTLWSNGVLESEMIIPKNLAGPVSQHNYRPGYHTQIAGPWHLGKLEMDFDFCDGTTVIVTEDCGNRGPSLRTTTASGKLITEWCCRSCTLPPLRYRGEDGCWYGMEIRPLKEKEENLVNSLVTAGHGQVDNFSLGVLGMALFLEEMLRTRVGTKHAILLVAVSFMTLITGNMSFKDLGRVVVMVGATMADDIGMGVTYLALLAAFKVRPTFAAGLLLRKLTSKELMMTTIGIVLLSQSTIPETVLELTDALALGMMVLKIVRNMEKYQLAVTIMAILCVPNAVILQNAWKVSCTILAVVSVSPLLLTSSQQKTDWIPLALTIKGLNPTAIFLTTLSRTNKKRSWPLNEAIMAVGMVSILASSLLKNDIPMTGPLVAGGLLTVCYVLTGRSADLELERATDVKWEDQAEISGSSPILSITISEDGSMSIKNEEEEQTLTILIRTGLLVISGLFPISIPITAAAWYLWEVKKQRAGVLWDVPSPPPMGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIIDKKGKVVGLYGNGVVTRSGAYVSAIAQTEKSIEDNPEIEDDIFRKRRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIIDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRRWCFDGIKNNQILEENVEVEIWTKEGERKKLKPRWLDARIYSDPLALKEFKEFAAGRKSLTLNLITEMGRLPTFMTQKTRDALDNLAVLHTAEAGGRAYNHALSELPETLETLLLLTLLATVTGGIFLFLMSGRGIGKMTLGMCCIITASILLWYAQIQPHWIAASIILEFFLIVLLIPEPEKQRTPQDNQLTYVVIAILTVVAATMANEMGFLEKTKKDLGLGSIATQQPESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFIPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESEVPNLDIIGKRIEKIKQEHETSWHYDQDHPYKTWAYHGSYETKQTGSASSMVNGVVRLLTKPWDVLPTVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKNIQHLTVTEEVAVQNWLARVGRERLSRMAISGDDCVVKPLDDRFANALTALNDMGKIRKDIQQWEPSKGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIRENPWMEDKTPVESWEEIPYLGKREDQWCGSLIGLTSRATWAKNIQAAINQVRSLIGNEEYTDYMPSMKRFRREEEEAGVLW

SEQ ID NO: 3903 - protein, 3291 aa, Artificial Sequence
  derived and/or modified protein sequence (wt) from DENV-2__FJ639709__SS-prME
SAGMIIMLIPTVMAFHLTTRNGEPHMIVGIQEKGKSLLFKTEDGVNMCTLMAMDLGELCEDTITYKCPLLRQNEPEDIDCWCNSTSTWVTYGTCTTTGEHRREKRSVALVPHVGMGLETRTETWMSSEGAWKHAQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLKEEQDKRFVCKHSMVDRGWGNGCGLFGKGGIVTCAMFTCKKNMEGKIVQPENLEYTIVVTPHSGEEHAVGNDTGKHGKEIKVTPQSSITEAELTGYGTVTMECSPRTGLDFNEMVLLQMENKAWLVHRQWFLDLPLPWLPGADKQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRYVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGIVTLYLGVMVQADSGCVVSWKNKELKCGSGIFITDNVHTWTEQYKFQPESPSKLASAIQKAQEEGICGIRSVTRLENLMWKQITPELNHILAENEVKLTIMTGDIKGIMQAGKRSLRPQPTELKYSWKTWGKAKMLSTESHNQTFLIDGPETAECPNTNRAWNSLEVEDYGFGVFTTNIWLKLKEKQDAFCDSKLMSAAIKDNRAVHADMGYWIESALNDTWKIEKASFIEVKNCHWPKSHTLWSNGVLESEMIIPKNLAGPVSQHNYRPGYHTQIAGPWHLGKLEMDFDFCDGTTVIVTEDCGNRGPSLRTTTASGKLITEWCCRSCTLPPLRYRGEDGCWYGMEIRPLKEKEENLVNSLVTAGHGQVDNFSLGVLGMALFLEEMLRTRVGTKHAILLVAVSFVTLITGNMSFKDLGRVVVMVGATMTDDIGMGVTYLALLAAFKVRPTFAAGLLLRKLTSKELMMTTIGIVLLSQTTIPETILELTDALALGMMVLKIVRDMEKYQLAVTIMAILCVPNAVILQNAWKVSCTILAVVSVSPLLLTSSQQKTDWIPLALTIKGLNPTAIFLTTLSRTNKKRSWPLNEAIMAVGMVSILASSLLKNDIPMTGPLVAGGLLTVCYVLTGRSADLELERATDVKWEDQAEISGSSPILSITISEDGSMSIKNEEEEQTLTILIRTGLLVISGLFPVSIPITAAAWYLWEVKKQRAGVLWDVPSPPPMGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIIDKKGKVVGLYGNGVVTRSGAYVSAIAQTEKSIEDNPEIEDDIFRKRRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIIDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRRWCFDGIKNNQILEENVEVEIWTKEGERKKLKPRWLDARIYSDPLALKEFKEFAAGRKSLTLNLITEMGRLPTFMTQKTRDALDNLAVLHTAEAGGRAYNHALSELPETLETLLLLTLLATVTGGIFLFLMSGRGIGKMTLGMCCIITASILLWNAQIQPHWIAASIILEFFLIVLLIPEPEKQRTPQDNQLTYVVIAILTVVAATMANEMGFLEKTKKDLGLGSIATQQPESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQTYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFIPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESEIPNLDIIGKRIEKIKQEHETSWHYDQDHPYKTWAYHGSYETKQTGSASSMVNGVVRLLTKPWDVLPTVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKNIQHLTATEEVAVQNWLARVGRERLSRMAISGDDCVVKPLDDRFANALTALNDMGKIRKDIQQWEPSKGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIRENPWMEDKTPVESWEEIPYLGKREDQWCGSLIGLTSRATWAKNIQAAINQVRSLIGNEEYTDYMPSMKRFRREEEEAGVLW

SEQ ID NO: 3904 - protein, 3291 aa, Artificial Sequence
  derived and/or modified protein sequence (wt) from DENV-2__FJ639710__SS-prME
SAGMIIMLIPTVMAFHLTTRNGEPHMIVGIQEKGKSLLFKTEDGVNMCTLMAMDLGELCEDTITYKCPLLRQNEPEDIDCWCNSTSTWVTYGTCTTTGEHRREKRSVALVPHVGMGLETRTETWMSSEGAWKHAQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLKEEQDKRFVCKHSMVDRGWGNGCGLFGKGAIVTCAMFTCKKNMEGKIVQPENLEYTIVVTPHSGEEHAVGNDTGKHGKEIKVTPQSSITEAELTGYGTVTMECSPRTGLDFNEMVLLQMENKAWLVHRQWFLDLPLPWLPGADKQESNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRYVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLILVGIVTLYLGVMVQADSGCVVSWKNKELKCGSGIFITDNVHTWTEQYKFQPESPSKLASAIQKAQEEGICGIRSVTRLENLMWKQITPELNHILAENEVKLTIMTGDIKGIMQAGRRSLRPQPTELKYSWKTWGKAKMLSTESYNQTFLIDGPETTECPNTNRAWNSLEVEDYGFGVFTTNIWLKLKEKQDAFCDSKLMSAAIKDNRAVHADMGYWIESALNDTWKIEKASFIEVKNCHWPKSHTLWSNGVLESEMIIPKNLAGPVSQHNYRPGYHTQIAGPWHLGKLEMDFDFCDGTTVIVTEDCGNRGPSLRTTTASGKLITEWCCRSCTLPPLRYRGEDGCWYGMEIRPLKEKEENLVNSLVTAGHGQVDNFSLGVLGMALFLEEMLRTRVGTKHAILLVAVSFVTLITGNMSFKDLGRVVVMVGATMADDIGMGVTYLALLAAFKVRPTFAAGLLLRKLTSKELMMTTIGIVLLSQSTIPETILELTDALALGMMVLKIVRNMEKYQLAVTIMAILCVPNAVILQNAWKVSCTILAVVSVSPLLLTSSQQKTDWIPLALTIKGLNPTAIFLTTLSRTNKKRSWPLNEAIMAVGMVSILASSLLKNDIPMTGPLVAGGLLTVCYVLTGRSADLELERATDVKWEEQAEISGSSPILSITISEDGSMSIKNEEEEQTLTILIRTGLLVISGLFPISIPITAAAWYLWEVKKQRAGVLWDVPSPPPMGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIIDKKGKVVGLYGNGVVTRSGAYVSAIAQTEKSIEDNPEIEDDIFRKRRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIIDEEREIPERSWNSGHEWITDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRRWCFDGIKNNQILEENVEVEIWTKEGERKKLKPRWLDARIYSDPLALKEFKEFAAGRKSLTLNLITEMGRLPTFMTQKTRDALDNLAVLHTAEAGGRAYNHALSELPETLETLLLLTLLATVTGGIFLFLMSGRGIGKMTLGMCCIITASILLWYAQIQPHWIAASIILEFFLIVLLIPEPEKQRTPQDNQLTYVVIAILTVVAATMANEMGFLEKTKKDLGLGSIATQQPESNILDIDLRPASAWTLYAVATTFITPMLRHSIENSSVNTSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVKEVKGLTKGGPGHEEPIPMSTYGWNLVRLQSGVDVFFIPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESEVPNLDIIGKRIEKIKQEHETSWHYDQDHPYKTWAYHGSYETKQTGSASSMVNGVVRLLTKPWDVLPTVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKNIQHLTVTEEVAVQNWLARVGRERLSRMAISGDDCVVKPLDDRFANALTALNDMGKIRKDIQQWEPSKGWNDWTQVPFCSHHFHELIMKDGRVLVVPCRNQDELIGRARISQGAGWSLRETACLGKSYAQMWSLIYFHRRDLRLAANAICSAVPSHWVPTSRTTWSIHAKHEWMTTEDMLTVWNRVWIRENPWMEDKTPVESWEEIPYLGKREDQWCGSLIGLTSRATWAKNIQAAINQVRSLIGNEEYTDYMPSMKRFRREEEEAGVLW

SEQ ID NO: 3905 - protein, 3291 aa, Artificial Sequence
  derived and/or modified protein sequence (wt) from DENV-2__GQ868623__SS-prME
SAGMIIMLIPTVMAFHLTTRNGEPHMIVGIQEKGKSLLFKTEDGVNMCTLMAMDLGELCEDTITYKCPLLRQNEPEDIDCWCNSTSTWVTYGTCTTTGEHRREKRSVALVPHVGMGLETRTETWMSSEGAWKHAQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLKEEQDKRFVCKHSMVDRGWGNGCGLFGKGGIVTCAMFTCKKNMEGKIVQPENLEYTIVVTPHSGEEHAVGNDTGKHGKEIKVTPQSSITEAELTGYGTVTMECSPRTGLDFNEMVLLQMENKAWLVHRQWFLDLPLPWLPGADKQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRYVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGIVTLYLGVMVQADSGCVVSWKNKELKCGSGIFITDNVHTWTEQYKFQPESPSKLASAIQKAQEEGICGIRSVTRLENLMWKQITPELNHILAENEVKLTIMTGDIKGIMQAGKRSLRPQPTELKYSWKTWGKAKMLSTESHNQTFLIDGPETAECPNTNRAWNSLEVEDYGFGVFTTNIWLKLKEKQDAFCDSKLMSAAIKDNRAVHADMGYWIESALNDTWKIEKASFIEVKNCHWPKSHTLWSNGVLESEMIIPKNLAGPVSQHNYRPGYHTQIAGPWHLGKLEMDFDFCDGTTVIVTEDCGNRGPSLRTTTASGKLITEWCCRSCTLPPLRYRGEDGCWYGMEIRPLKEKEENLVNSLVTAGHGQVDNFSLGVLGLALFLEEMLRTRVGTKHAILLVAVSFVTLITGNMSVKDLGRVVVMVGATMTDDIGMGVTYLALLAAFKVRPTFAAGLLLRKLTSKELMMTTIGIVLLSQSTIPETILELTDALALGMMVLKIVRDMEKYQLAVTIMAILCVPNAVILQNAWKVSCTILAVVSVSPLLLTSSQQKTDWIPLALTIKGLNPTAIFLTTLSRTNKKRSWPLNEAIMAVGMVSILASSLLKNDIPMTGPLVAGGLLTVCYVLTGRSADLELERATDVKWEDQAEISGSSPILSITISEDGSMSIKNEEEEQTLTILIRTGLLVISGLFPVSIPITAAAWYLWEVKKQRAGVLWDVPSPPPMGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIIDKKGKVVGLYGNGVVTRSGAYVSAIAQTEKSIEDNPEIEDDIFRKRRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIIDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGTNYADRRWCFDGIKNNQILEENVEVEIWTKEGERKKLKPRWLDARIYSDPLALKEFKEFAAGRKSLTLNLITEMGRLPTFMTQKTRDALDNLAVLHTAEAGGRAYNHALSELPETLETLLLLTLLATVTGGIFLFLMSGRGIGKMTLGMCCIITASILLWYAQIQPHWIAASIILEFFLIVLLIPEPEKQRTPQDNQLTYVVIAILTVVAATMANEMGFLEKTKKDLGLGSIATQQPESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQTYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFIPPEKCDTLLCDIGESSPNPTVEAGRTLRVLNLVENWLNNNTQFCIKVLNPYMPSVIEKMEALQRKHGGALVRNPLSRNSTHEMYWVSNASGNIVSSVNMISRMLINRFTMRHKKATYEPDVDLGSGTRNIGIESEIPNLDIIGKRIEKIKQEHETSWHYDQDHPYKTWAYHGSYETKQTGSASSMVNGVVRLLTKPWDVLPTVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDRERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKNIQHLTATEEVAVQNWLARVGRERLSRMAISGDDCVVKPLDDRFANALTALNDMGKIRKDIQQWEPSKGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIRENPWMEDKTPVESWEEIPYLGKREDQWCGSLIGLTSRATWAKNIQAAINQVRSLIGNEEYTDYMPSMKRFRREEEEAGVLW

SEQ ID NO: 3906 - protein, 3291 aa, Artificial Sequence
  derived and/or modified protein sequence (wt) from DENV-2__GQ868624__SS-prME
SAGMIIMLIPTVMAFHLTTRNGEPHMIVGIQEKGKSLLFKTEDGVNMCTLMAMDLGELCEDTITYKCPLLRQNEPEDIDCWCNSTSTWVTYGTCTTTGEHRREKRSVALVPHVGMGLETRTETWMSSEGAWKHAQRIETWILRHPGFTIMAAILAYTIGTTHFQRVLIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLKEEQDKRFVCKHSMVDRGWGNGCGLFGKGGIVTCAMFTCKKNMEGKIVQPENLEYTIVVTPHSGEEHAVGNDTGKHGMEIKVTPQSSITEAELTGYGTVTMECSPRTGLDFNEMVLLQMENKAWLVHRQWFLDLPLPWLPGADKQESNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRYVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGIVTLYLGVMVQADSGCVVSWKNKELKCGSGIFITDNVHTWTEQYKFQPESPSKLASAIQKAQEEGICGIRSVTRLENLMWKQITPELNHILAENEVKLTIMTGDIKGIMQAGKRSLRPQPTELKYSWKTWGKAKMLSTESYNQTFLIDGPETAECPNTNRAWNSLEVEDYGFGVFTTNIWLKLKEKQDAFCDSKLMSAAIKDNRAVHADMGYWIESALNDTWKIEKASFIEVKNCHWPKSHTLWSNGVLESEMIIPKNLAGPVSQHNYRPGYHTQIAGPWHLGKLEMDFDFCDGTTVIVTEDCGNRGPSLRTTTASGKLITEWCCRSCTLPPLRYRGEDGCWYGMEIRPLKEKEENLVNSLVTAGHGQVDNFSLGVLGMALFLEEMLRTRVGTKHAILLVAVSFVTLITGNMSFKDLGRVVVMVGATMADDIGMGVTYLALLAAFKVRPTFAAGLLLRKLTSKELMMTTIGIVLLSQSTIPETVLELTDALALGMMVLKIVRNMEKYQLAVTIMAILCVPNAVILQNAWKVSCTILAVVSVSPLLLTSSQQKTDWIPLALTIKGLNPTAIFLTTLSRTNKKRSWPLNEAIMAVGMVSILASSLLKNDIPMTGPLVAGGLLTVCYVLTGRSADLELERATDVKWEDQAEISGSSPILSITISEDGSMSIKNEEEEQTLTILIRTGLLVISGLFPISIPITAAAWYLWEVKKQRAGVLWDVPSPPPMGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIIDKKGKVVGLYGNGVVTRSGAYVSAIAQTEKSIEDNPEIEDDIFRKRRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIIDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRRWCFDGIKNNQILEENVEVEIWTKEGERKKLKPRWLDARIYSDPLALKEFKEFAAGRKSLTLNLITEMGRLPTFMTQKTRDALDNLAVLHTAEAGGRAYNHALSELPETLETLLLLTLLATVTGGIFLFLMSGRGIGKMTLGMCCIITASILLWYAQIQPHWIAASIILEFFLIVLLIPEPEKQRTPQDNQLTYVVIAILTVVAATMANEMGFLEKTKKDLGLGSIATQQPESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFIPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESEIPNLDIIGKRIEKIKEEHETSWHYDQDHPYKTWAYHGSYETKQTGSASSMVNGVVRLLTKPWDVLPTVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKNIQHLTVTEEAAVQNWLARVGRERLSRMAISGDDCVVKPLDDRFANALTALNDMGKIRKDIQQWEPSKGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIRENPWMEDKTPVESWEEIPYLGKREDQWCGSLIGLTSRATWAKNIQAAINQVRSLIGNEEYTDYMPSMKRFRREEEEAGVLW

SEQ ID NO: 3907 - protein, 3291 aa, Artificial Sequence
  derived and/or modified protein sequence (wt) from DENV-2__FJ639717__SS-prME
SAGMIIMLIPTVMAFHLTTRNGEPHMIVGIQEKGKSLLFKTEDGVNMCTLMAMDLGELCEDTITYKCPLLRQNEPEDIDCWCNSTSTWVTYGTCTTTGEHRREKRSVALVPHVGMGLETRTETWMSSEGAWKHAQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLKEEQDKRFVCKHSMVDRGWGNGCGLFGKGGIVTCAMFTCKKNMEGKIVQPENLEYTIVVTPHSGEEHAVGNDTGKHGKEIKVTPQSSITEAELTGYGTVTMECSPRTGLDFNEMVLLQMESKAWLVHRQWFLDLPLPWLPGADKQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRYVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGIVTLYLGVMVQADSGCVVSWKNKELKCGSGIFITDNVHTWTEQYKFQPESPSKLASAIQKAQEEGICGIRSVTRLENLMWKQITPELNHILAENEVKLTIMTGDIKGIMQAGKRSLRPQPTELKYSWKTWGKAKMLSTESHNQTFLIDGPETAECPNTNRAWNSLEVEDYGFGVFTTNIWLKLKEKQDAFCDSKLMSAAIKDNRAVHADMGYWIESALNDTWKIEKASFIEVKNCHWPKSHTLWSNGVLESEMIIPKNLAGPVSQHNYRPGYHTQTAGPWHLGKLEMDFDFCDGTTVIVTEDCGNRGPSLRTTTASGKLITEWCCRSCTLPPLRYRGEDGCWYGMEIRPLKEKEENLVNSLVTAGHGQVDNFSLGVLGMALFLEEMLRTRVGTKHAILLVAVSFVTLITGNMSFKDLGRVVVMVGTTMTDDIGMGVTYLALLAAFKVRPTFAAGLLLRKLTSKELMMTTIGIVLLSQSTIPETILELTDALALGMMVLKIVRDMEKYQLAVTIMAILCVPNAVILQNAWKVSCTILAVVSVSPLLLTSSQQKTDWIPLALTIKGLNPTAIFLTTLSRTNKKRSWPLNEAIMAVGMVSILASSLLKNDIPMTGPLVAGGLLTVCYVLTGRSADLELERATDVKWEDQAEISGSSPILSITISEDGSMSIKNEEEEQTLTILIRTGLLVISGLFPVSIPITAAAWYLWEVKKQRAGVLWDVPSPPPMGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIIDKKGKVVGLYGNGVVTRSGAYVSAIAQTEKSIEDNPEIEDDIFRKRRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIIDEEREIPERSWNTGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRRWCFDGIKNNQILEENVEVEIWTKEGERKKLKPRWLDARIYSDPLALKEFKEFAAGRKSLTLNLITEMGRLPTFMTQKTRDALDNLAVLHTAEAGGRAYNHALSELPETLETLLLLTLLATVTGGIFLFLMSGRGIGKMTLGMCCIITASVLLWYAQIQPHWIAASIILEFFLIVLLIPEPEKQRTPQDNQLTYVVIAILTVVAATMANEMGFLEKTKKDLGLGSIATQQPESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQTYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFIPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESEIPNLDIIGKRIEKIKQEHETSWHYDQDHPYKTWAYHGSYETKQTGSASSMVNGVVRLLTKPWDVLPTVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKNIQHLTATEEVAVQNWLARVGRERLSRMAISGDDCVVKPLDDRFANALTALNDMGKIRKDIQQWEPSKGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIRENPWMEDKTPVESWEEIPYLGKREDQWCGSLIGLTSRATWAKNIQAAINQVRSLIGNEEYTDYMPSMKRFRREEEEAGVLW

SEQ ID NO: 3908 - protein, 3291 aa, Artificial Sequence
  derived and/or modified protein sequence (wt) from DENV-2__FJ639718__SS-prME
SAGMIIMLIPTVMAFHLTTRNGEPHMIVGIQEKGKSLLFKTEDGVNMCTLMAMDLGELCEDTITYKCPLLRQNEPEDIDCWCNSTSTWVTYGTCTTTGEHRREKRSVALVPHVGMGLETRTETWMSSEGAWKHAQRIETWILRHPGFTIMAAILAYTIGTTHFQRVLIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLKEEQDKRFVCKHSMVDRGWGNGCGLFGKGGIVTCAMFTCKKNMEGKIVQPENLEYTIVVTPHSGEEHAVGNDTGKHGMEIKVTPQSSITEAELTGYGTVTMECSPRTGLDFNEMVLLQMENKAWLVHRQWFLDLPLPWLPGADKQESNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRYVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGIVTLYLGVMVQADSGCVVSWKNKELKCGSGIFITDNVHTWTEQYKFQPESPSKLASAIQKAQEEGICGIRSVTRLENLMWKQITPELNHILAENEVKLTIMTGDIKGIMQAGKRSLRPQPTELKYSWKTWGKAKMLSTESYNQTFLIDGPETAECPNTNRAWNSLEVEDYGFGVFTTNIWLKLKEKQDAFCDSKLMSAAIKDNRAVHADMGYWIESALNDTWKIEKASFIEVKNCHWPKSHTLWSNGVLESEMIIPKNLAGPVSQHNYRPGYHTQIAGPWHLGKLEMDFDFCDGTTVIVTEDCGNRGPSLRTTTASGKLITEWCCRSCTLPPLRYRGEDGCWYGMEIRPLKEKEENLVNSLVTAGHGQVDNFSLGVLGMALFLEEMLRTRVGTKHAILLVAVSFVTLITGNMSFKDLGRVVVMVGATMADDIGMGVTYLALLAAFKVRPTFAAGLLLRKLTSKELMMTTIGIVLLSQSTIPETVLELTDALALGMMVLKIVRNMEKYQLAVTIMAILCVPNAVILQNAWKVSCTILAVVSVSPLLLTSSQQKTDWIPLALTIKGLNPTAIFLTTLSRTNKKRSWPLNEAIMAVGMVSILASSLLKNDIPMTGPLVAGGLLTVCYVLTGRSADLELEKATDVKWEDQAEISGSSPILSITISEDGSMSIKNEEEEQTLTILIRTGLLVISGLFPISIPITAAAWYLWEVKKQRAGVLWDVPSPPPMGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIIDKKGKVVGLYGNGVVTRSGAYVSAIAQTEKSIEDNPEIEDDIFRKRRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIIDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRRWCFDGIKNNQILEENVEVEIWTKEGERKKLKPRWLDARIYSDPLALKEFKEFAAGRKSLTLNLITEMGRLPTFMTQKTRDALDNLAVLHTAEAGGRAYNHALSELPETLETLLLLTLLATVTGGIFLFLMSGRGIGKMTLGMCCIITASILLWYAQIQPHWIAASIILEFFLIVLLIPEPEKQRTPQDNQLTYVVIAILTVVAATMANEMGFLEKTKKDLGLGSIATQQPESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFIPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESEIPNLDIIGKRIEKIKEEHETSWHYDQDHPYKTWAYHGSYETKQTGSASSMVNGVVRLLTKPWDVLPTVTQMAMTDTTPFGQQRVFKEKVDTRTQEPKEGTKKLMKITAEWLWKELGKKKTPRMCTREEFTRKVRSNAALGAIFTDENKWKSAREAVEDNRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKNIQHLTVTEEAAVQNWLARVGRERLSRMAISGDDCVVKPLDDRFANALTALNDMGKIRKDIQQWEPSKGWNDWTQVPFCSHHFHELVMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIRENPWMEDKTPVESWEEIPYLGKREDQWCGSLIGLTSRATWAKNIQAAINQVRSLIGNEEYTDYMPSMKRFRREEEEAGVLW

SEQ ID NO: 3909 - protein, 3291 aa, Artificial Sequence
  derived and/or modified protein sequence (wt) from DENV-2__GQ868625__SS-prME
SAGMIIMLIPTVMAFHLTTRNGEPHMIVGIQEKGKSLLFKTEDGVNMCTLMAMDLGELCEDTITYKCPLLRQNEPEDIDCWCNSTSTWVTYGTCTTTGEHRREKRSVALVPHVGMGLETRTETWMSSEGAWKHAQRIETWILRHPGFTIMAAILAYTIGTTHFQRVLIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLKEEQDKRFVCKHSMVDRGWGNGCGLFGKGGIVTCAMFTCKKNMEGKIVQPENLEYTIVVTPHSGEEHAVGNDTGKHGMEIKVTPQSSITEAELTGYGTVTMECSPRTGLDFNEMVLLQMENKAWLVHRQWFLDLPLPWLPGADKQESNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRYVLGRLITVNPIVTEKDSPVNIEAEPPFGDSYIIIGVEPGQLKLNWFKKGSSIGRMFETTMRGAKRMAILGDTAWDFGSLGGVFTSIGKALHQVFGAIYGAAFSGVSWTMKILIGVIITWIGMNSRSTSLSVSLVLVGIVTLYLGVMVQADSGCVVSWKNKELKCGSGIFITDNVHTWTEQYKFQPESPSKLASAIQKAQEEGICGIRSVTRLENLMWKQITPELNHILAENEVKLTIMTGDIKGIMQAGKRSLRPQPTELKYSWKTWGKAKMLSTESYNQTFLIDGPETAECPNTNRAWNSLEVEDYGFGVFTTNIWLKLKEKQDAFCDSKLMSAAIKDNRAVHADMGYWIESALNDTWKIEKASFIEVKNCHWPKSHTLWSNGVLESEMIIPKNLAGPVSQHNYRPGYHTQIAGPWHLGKLEMDFDFCDGTTVIVTEDCGNRGPSLRTTTASGKLITEWCCRSCTLPPLRYRGEDGCWYGMEIRPLKEKEENLVNSLVTAGHGQVDNFSLGVLGMALFLEEMLRTRVGTKHAILLVAVSFVTLITGNMSFKDLGRVVVMVGATMADDIGMGVTYLALLAAFKVRPTFAAGLLLRKLTSKELMMTTIGIVLLSQSTIPETVLELTDALALGMMVLKIVRNMEKYQLAVTIMAILCVPNAVILQNAWKVSCTILAVVSVSPLLLTSSQQKTDWIPLALTIKGLNPTAIFLTTLSRTNKKRSWPLNEAIMAVGMVSILASSLLKNDIPMTGPLVAGGLLTVCYVLTGRSADLELERATDVKWEDQAEISGSSPILSITISEDGSMSIKNEEEEQTLTILIRTGLLVISGLFPISIPITAAAWYLWEVKKQRAGVLWDVPSPPPMGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIIDKKGKVVGLYGNGVVTRSGAYVSAIAQTEKSIEDNPEIEDDIFRKRRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIIDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRRWCFDGIKNNQILEENVEVEIWTKEGERKKLKPRWLDARIYSDPLALKEFKEFAAGRKSLTLNLITEMGRLPTFMTQKTRDALDNLAVLHTAEAGGRAYNHALSELPETLETLLLLTLLATVTGGIFLFLMSGRGIGKMTLGMCCIITASILLWYAQIQPHWIAASIILEFFLIVLLIPEPEKQRTPQDNQLTYVVIAILTVVAATMANEMGFLEKTKKDLGLGSIATQQPESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFIPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESEIPNLDIIGKRIEKIKEEHETSWHYDQDHPYKTWAYHGSYETKQTGSASSMVNGVVRLLTKPWDVLPTVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKNIQHLTVTEEAAVQNWLARVGRERLSRMAISGDDCVVKPLDDRFANALTALNDMGKIRKDIQQWEPSKGWNDWTQVPFCSHHFHELVMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIRENPWMEDKTPVESWEEIPYLGKREDQWCGSLIGLTSRATWAKNIQAAINQVRSLIGNEEYTDYMPSMKRFRREEEEAGVLW

SEQ ID NO: 3910 - protein, 3291 aa, Artificial Sequence
  derived and/or modified protein sequence (wt) from DENV-2__KF955401__SS-prME
SAGMIIMLIPTVMAFHLTTRNGEPHMIVGIQEKGKSLLFKTEDGVNMCTLMAMDLGELCEDTITYKCPLLRQNEPEDIDCWCNSTSTWVTYGTCTTTGEHRREKRSVALVPHVGMGLETRTETWMSSEGAWKHAQRIETWILRHPGFTIMAAILAYTIGTTHFQRVLIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLKEEQDKRFVCKHSMVDRGWGNGCGLFGKGGIVTCAMFTCKKNMEGKIVQPENLEYTIVVTPHSGEEHAVGNDTGKHGMEIKVTPQSSITEAELTGYGTVTMECSPRTGLDFNEMVLLQMENKAWLVHRQWFLDLPLPWLPGADKQESNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRYVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGVAFSGVSWTMKILIGVIITWIGMNSRSTSLSVSLVLVGIVTLYLGVMVQADSGCVVSWKNKELKCGSGIFITDNVHTWTEQYKFQPESPSKLASAIQKAQEEGICGIRSVTRLENLMWKQITPELNHILAENEVKLTIMTGDIKGIMQAGKRSLRPQPTELKYSWKTWGKAKMLFTESYNQTFLIDGPETAECPNTNRAWNSLEVEDYGFGVFTTNIWLKLKEKQDAFCDSKLMSAAIKDNRAVHADMGYWIESALNDTWKIEKASFIEVKNCHWPKSHTLWSNGVLESEMIIPKNLAGPVSQHNYRPGYHTQIAGPWHLGKLEMDFDFCDGTTVIVTEDCGNRGPSLRTTTASGKLITEWCCRSCTLPPLRYRGEDGCWYGMEIRPLKEKEENLVNSLVTAGHGQVDNFSLGVLGMALFLEEMLRTRVGTKHAILLVAVSFVTLITGNMSFKDLGRVVVMVGATMADDIGMGVTYLALLAAFKVRPTFAAGLLLRKLTSKELMMTTIGIVLLSQSTIPETVLELTDALALGMMVLKIVRNMEKYQLAVTIMAILCVPNAVILQNAWKVSCTILAVVSVSPLLLTSSQQKTDWIPLALTIKGLNPTAIFLTTLSRTNKKRSWPLNEAIMAVGMVSILASSLLKNDIPMTGPLVAGGLLTVCYVLTGRSADLELERATDVKWEDQAEISGSSPILSITISEDGSMSIKNEEEEQTLTILIRTGLLVISGLFPISIPITAAAWYLWEVKKQRAGVLWDVPSPPPMGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIIDKKGKVVGLYGNGVVTRSGAYVSAIAQTEKSIEDNPEIEDDIFRKRRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIIDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRRWCFDGIKNNQILEENVEVEIWTKEGERKKLKPRWLDARIYSDPLALKEFKEFAAGRKSLTLNLITEMGRLPTFMTQKTRDALDNLAVLHTAEAGGRAYNHALSELPETLETLLLLTLLATVTGGIFLFLMSGRGIGKMTLGMCCIITASILLWYAQIQPHWIAASIILEFFLIVLLIPEPEKQRTPQDNQLTYVVIAILTVVAATMANEMGFLEKTKKDLGLGSIATQQPESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFIPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESETPNLDIIGKRIEKIKEEHETSWHYDQDHPYKTWAYHGSYETKQTGSASSMVNGVVRLLTKPWDVLPTVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKNIQHLTVTEEAAVQNWLARVGRERLSRMAISGDDCVVKPLDDRFANALTALNDMGKIRKDIQQWEPSKGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIRENPWMEDKTPVESWEEIPYLGKREDQWCGSLIGLTSRATWAKNIQAAINQVRSLIGNEEYTDYMPSMKRFRREEEEAGVLW

SEQ ID NO: 3911 - protein, 3291 aa, Artificial Sequence
  derived and/or modified protein sequence (wt) from DENV-2__JF730047__SS-prME
SAGMIIMLIPTVMAFHLTTRNGEPHMIVGIQEKGKSLLFKTEDGVNMCTLMAMDLGELCEDTITYKCPLLRQNEPEDIDCWCNSTSTWVTYGTCTTTGEHRREKRSVALVPHVGMGLETRTETWMSSEGAWKHAQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLKEEQDKRFVCKHSMVDRGWGNGCGLFGKGGIVTCAMFTCKKNMEGKIVQPENLEYTIVVTPHSGEEHAVGNDTGKHGKEIKVTPQSSITEAELTGYGTVTMECSPRTGLDFNEMVLLQMESKAWLVHRQWFLDLPLPWLPGADKQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRYVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGIVTLYLGVMVQADSGCVVSWKNKELKCGSGIFITDNVHTWTEQYKFQPESPSKLASAIQKAQEEGICGIRSVTRLENLMWKQITPELNHILAENEVKLTIMTGDIKGIMQAGKRSLRPQPTELKYSWKTWGKAKMLSTESHNQTFLIDGPETAECPNTNRAWNSLEVEDYGFGVFTTNIWLKLKEKQDAFCDSKLMSAAIKDNRAVHADMGYWIESALNDTWKIEKASFIEVKNCHWPKSHTLWSNGVLESEMIIPKNLAGPVSQHNYRPGYHTQTAGPWHLGKLEMDFDFCDGTTVIVTEDCGNRGPSLRTTTASGKLITEWCCRSCTLPPLRYRGEDGCWYGMEIRPLKEKEENLVNSLVTAGHGQVDNFSLGVLGMALFLEEMLRTRVGTKHAILLVAVSFVTLITGNMSFKDLGRVVVMVGTTMTDDIGMGVTYLALLAAFKVRPTFAAGLLLRKLTSKELMMTTIGIVLLSQSTIPETILELTDALALGMMVLKIVRDMEKYQLAVTIMAILCVPNAVILQNAWKVSCTILAVVSVSPLLLTSSQQKTDWIPLALTIKGLNPTAIFLTTLSRTNKKRSWPLNEAIMAVGMVSILASSLLKNDIPMTGPLVAGGLLTVCYVLTGRSADLELERATDVKWEDQAEISGSSPILSITISEDGSMSIKNEEEEQTLTILIRTGLLVISGLFPVSIPITAAAWYLWEVKKQRAGVLWDVPSPPPMGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIIDKKGKVVGLYGNGVVTRSGAYVSAIAQTEKSIEDNPEIEDDIFRKRRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIIDEEREIPERSWNTGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRRWCFDGIKNNQILEENVEVEIWTKEGERKKLKPRWLDARIYSDPLALKEFKEFAAGRKSLTLNLITEMGRLPTFMTQKTRDALDNLAVLHTAEAGGRAYNHALSELPETLETLLLLTLLATVTGGIFLFLMSGRGIGKMTLGMCCIITASILLWYAQIQPHWIAASIILEFFLIVLLIPEPEKQRTPQDNQLTYVVIAILTVVAATMANEMGFLEKTKKDLGLGSIATQQPESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQTYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFIPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESEIPNLDIIGKRIEKIKQEHETSWHYDQDHPYKTWAYHGSYETKQTGSASSMVNGVVRLLTKPWDVLPTVTQMAMTDTTPFGQQRVFKEKVDTRTQEPKEGTKKLMKITAEWLWKELGKKKTPRMCTREEFIRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKNIQHLTATEEVAVKNWLARVGRERLSRMAISGDDCVVKPLDDRFANALTALNDMGKIRKDIQQWEPSKGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIRENPWMEDKTPVESWEEIPYLGKREDQWCGSLIGLTSRATWAKNIQAAINQVRSLIGNEEYTDYMPSMKRFRREEEEAGVLW

SEQ ID NO: 3912 - protein, 3291 aa, Artificial Sequence
  derived and/or modified protein sequence (wt) from DENV-2__JF730048__SS-prME
SAGMIIMLIPTVMAFHLTTRNGEPHMIVGIQEKGKSLLFKTEDGVNMCTLMAMDLGELCEDTITYKCPLLRQNEPEDIDCWCNSTSTWVTYGTCTTTGEHRREKRSVALVPHVGMGLETRTETWMSSEGAWKHAQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLKEEQDKRFVCKHSMVDRGWGNGCGLFGKGGIVTCAMFTCKKNMEGKIVQPENLEYTIVVTPHSGEEHAVGNDTGKHGKEIKVTPQSSITEAELTGYGTVTMECSPRTGLDFNEMVLLQMESKAWLVHRQWFLDLPLPWLPGADKQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRYVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGIVTLYLGVMVQADSGCVVSWKNKELKCGSGIFITDNVHTWTEQYKFQPESPSKLASAIQKAQEEGICGIRSVTRLENLMWKQITPELNHILAENEVKLTIMTGDIKGIMQAGKRSLRPQPTELKYSWKTWGKAKMLSTESHNQTFLIDGPETAECPNTNRAWNSLEVEDYGFGVFTTNIWLKLKEKQDAFCDSKLMSAAIKDNRAVHADMGYWIESALNDTWKIEKASFIEVKNCHWPKSHTLWSNGVLESEMIIPKNLAGPVSQHNYRPGYHTQTAGPWHLGKLEMDFDFCDGTTVIVTEDCGNRGPSLRTTTASGKLITEWCCRSCTLPPLRYRGEDGCWYGMEIRPLKEKEENLVNSLVTAGHGQVDNFSLGVLGMALFLEEMLRTRVGTKHAILLVAVSFVTLITGNMSFKDLGRVVVMVGTTMTDDIGMGVTYLALLAAFKVRPTFAAGLLLRKLTSKELMMTTIGIVLLSQSTIPETILELTDALALGMMVLKIVRDMEKYQLAVTIMAILCVPNAVILQNAWKVSCTILAVVSVSPLLLTSSQQKTDWIPLALTIKGLNPTAIFLTTLSRTNKKRSWPLNEAIMAVGMVSILASSLLKNDIPMTGPLVAGGLLTVCYVLTGRSADLELERATDVKWEDQAEISGSSPILSITISEDGSMSIKNEEEEQTLTILIRTGLLVISGLFPVSIPITAAAWYLWEVKKQRAGVLWDVPSPPPMGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIIDKKGKVVGLYGNGVVTRSGAYVSAIAQTEKSIEDNPEIEDDIFRKRRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDSFPQSNAPIIDEEREIPERSWNTGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRRWCFDGIKNNQILEENVEVEIWTKEGERKKLKPRWLDARIYSDPLALKEFKEFAAGRKSLTLNLITEMGRLPTFMTQKTRDALDNLAVLHTAEAGGRAYNHALSELPETLETLLLLTLLATVTGGIFLFLMSGRGIGKMTLGMCCIITASILLWYAQIQPHWIAASIILEFFLIVLLIPEPEKQRTPQDNQLTYVVIAILTVVAATMANEMGFLEKTKKDLGLGSIATQQPESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQTYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFIPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESEIPNLDIIGKRIEKIKQEHETSWHYDQDHPYKTWAYHGSYETKQTGSASSMVNGVVRLLTKPWDVLPTVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKNIQHLTATEEVAVKNWLARVGRERLSRMAISGDDCVVKPLDDRFANALTALNDMGKIRKDIQQWEPSKGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIRENPWMEDKTPVESWEEIPYLGKREDQWCGSLIGLTSRATWAKNIQAAINQVRSLIGNEEYTDYMPSMKRFRREEEEAGVLW

SEQ ID NO: 3913 - protein, 3291 aa, Artificial Sequence
  derived and/or modified protein sequence (wt) from DENV-2__KF955402__SS-prME
SAGMIIMLIPTVMAFHLTTRNGEPHMIVGIQEKGKSLLFKTEDGVNMCTLMAMDLGELCEDTITYKCPLLRQNEPEDIDCWCNSTSTWVTYGTCTTTGEHRREKRSVALVPHVGMGLETRTETWMSSEGAWKHAQRIETWILRHPGFTIMAAILAYTIGTTHFQRVLIFILLTAVAPSMTMRCIGISNRVFVEGVSGGSWVDIVLEHGSCVTTMAKNKPTLDFELIKTEAKQPATLRKYCIEAKLTNTTTESRCPTQGEPSLKEEQDKRFVCKHSMVDRGWGNGCGLFGKGGIVTCAMFTCKKNMEGKIVQPENLEYTIVVTPHSGEEHAVGNDTGKHGMEIKVTPQSSITEAELTGYGTVTMECSPRTGLDFNEMVLLQMENKAWLVHRQWFLDLPLPWLPGADKQESNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRYVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGVAFSGVSWTMKILIGVIITWIGMNSRSTSLSVSLVLVGIVTLYLGVMVQADSGCVVSWKNKELKCGSGIFITDNVHTWTEQYKFQPESPSKLASAIQKAQEEGICGIRSVTRLENLMWKQITPELNHILAENEVKLTIMTGDIKGIMQAGKRSLRPQPTELKYSWKTWGKAKMLSTESYNQTFLIDGPETAECPNTNRAWNSLEVEDYGFGVFTTNIWLKLKEKQDAFCDSKLMSAAIKDNRAVHADMGYWIESALNDTWKIEKASFIEVKNCHWPKSHTLWSNGVLESEMIIPKNLAGPVSQHNYRPGYHTQIAGPWHLGKLEMDFDFCDGTTVIVTEDCGNRGPSLRTTTASGKLITEWCCRSCTLPPLRYRGEDGCWYGMEIRPLKEKEENLVNSLVTAGHGQVDNFSLGVLGMALFLEEMLRTRVGTKHAILLVAVSFVTLITGNMSFKDLGRVVVMVGATMADDIGMGVTYLALLAAFKVRPTFAAGLLLRKLTSKELMMTTIGIVLLSQSTIPETVLELTDALALGMMVLKIVRNMEKYQLAVTIMAILCVPNAVILQNAWKVSCTILAVVSVSPLLLTSSQQKTDWIPLALTIKGLNPTAIFLTTLSRTNKKRSWPLNEAIMAVGMVSILASSLLKNDIPMTGPLVAGGLLTVCYVLTGRSADLELERATDVKWEDQAEISGSSPILSITISEDGSMSIKNEEEEQTLTILIRTGLLVISGLFPISIPITAAAWYLWEVKKQRAGVLWDVPSPPPMGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIIDKKGKVVGLYGNGVVTRSGAYVSAIAQTEKSIEDNPEIEDDIFRKRRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIIDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRRWCFDGIKNNQILEENVEVEIWTKEGERKKLKPRWLDARIYSDPLALKEFKEFAAGRKSLTLNLITEMGRLPTFMTQKTRDALDNLAVLHTAEAGGRAYNHALSELPETLETLLLLTLLATVTGGIFLFLMSGRGIGKMTLGMCCIITASILLWYAQIQPHWIAASIILEFFLIVLLIPEPEKQRTPQDNQLTYVVIAILTVVAATMANEMGFLEKTKKDLGLGSIATQQPESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFIPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESETPNLDIIGKRIEKIKEEHETSWHYDQDHPYKTWAYHGSYETKQTGSASSMVNGVVRLLTKPWDVLPTVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKNIQHLTVTEEAAVQNWLARVGRERLSRMAISGDDCVVKPLDDRFANALTALNDMGKIRKDIQQWEPSKGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIRENPWMEDKTPVESWEEIPYLGKREDQWCGSLIGLTSRATWAKNIQAAINQVRSLIGNEEYTDYMPSMKRFRREEEEAGVLW

SEQ ID NO: 3914 - protein, 3291 aa, Artificial Sequence
  derived and/or modified protein sequence (wt) from DENV-2__FJ898460__SS-prME
TAGVIVMLIPTAIAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVQPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEITDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFNGVSWTMKILIGVIITWIGMNSRSTSLSVSLVLVGVVTLYLGAMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFSTNIWLKLREKQDVFCDSKLMSAAIKDNRAVHADMGYWIESALNDTWKMEKASFIEVKSCHWPKSHTLWSNGVLESEMIIPKSFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMATIGIALLSQSTMPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVGKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGIFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRKWCFDGIKNNQILEENVEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPVPMSTYGWNLVRLQSGVDVFFTPPEKCDTLLCDIGESSPNPTIEAGRTLRVLNLVENWLNNNTQFCIKVLNPYMPSVIEKMETLQRKYGGALVRNPLSRNSTHEMYWVSNATGNIVSSVNMISRMLINRFTMKHKKATYEPDVDLGSGTRNIGIESETPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTKKVRSNAALGAIFTDENKWKSAREAVEDGRFWELVDRERNLHLEGKCETCVYNMMGKREKKLGEFGKAKGSRAIWYMWLGARFLEFEALGFLNEDHWFSRGNSLSGVEGEGLHRLGYILREVGKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKSIQHLTATEEIAVQNWLARVGRERLSRMAISGDDCVVKPIDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 3915 - protein, 3291 aa, Artificial Sequence
  derived and/or modified protein sequence (wt) from DENV-2__FJ882602__SS-prME
TAGMIIMLIPTAMAFHLTTRNGEPHMIVSRQEKGKSLLFKTEDGVNMCTLMAMDLGELCEDTITYNCPLLRQNEPEDIDCWCNSTSTWVTYGTCTATGEHRREKRSVALVPHVGMGLETRTETWMSSEGAWKHAQRIETWILRHPGFTIMAAILAYTIGTTYFQRVLIFILLTAVAPSMTMRCIGISNRDFVEGVSGGSWVDIVLEHGSCVTTMAKNKPTLDFELIKTEAKQPATLRKYCIEAKLTNTTTASRCPTQGEPSLNEEQDKRFVCKHSMVDRGWGNGCGLFGKGGIVTCAMFTCKKNMEGKIVQPENLEYTIVITPHSGEENAVGNDTGKHGKEIKVTPQSSITEAELTGYGTVTMECSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRHVLGRLITVNPIVTEKDSPVNIEAEPPFGDSYIIIGVEPGQLKLSWFKKGSSIGQMFETTMRGAKRMAILGDTAWDFGSLGGVFTSIGKALHQVFGAIYGAAFSGVSWTMKILIGVVITWIGMNSRSTSLSVALVLVGVVTLYLGVMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTEPHNQTFLIDGPETAECPNTNRAWNSLEVEDYGFGVFTTNIWLKLKERQDVFCDSKLMSAAIKDNRAVHADMGYWIESALNDTWKIEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGDDGCWYGMEIRPLKEKEENLVNSLVTAGYGQIDNFSLGVLGMALFLEEMLRTRVGTKHAVLLVAVSFMTLITGNMSFRDLGRVVVMVGAAMTDDIGMGVTYLALLAAFKVRPTFAAGLLLRKLTSKELMMTTIGIVLLSQSTIPETILELTDALALGMMILKIVRNMEKYQLAVTIMAILCVPNAVILQNAWKVSCTILAVVSVSPLLLTSSQQKADWIPLALTIKGLNPTAIFLTTLSRTNKKRSWPLNEAIMAVGMVSILASSLLKNDIPMTGPLVAGGLLTVCYVLTGRSADLELERAADVRWEDQAEISGSSPILSITISEDGSMSIKNEEEEQTLTILIRTGLLVISGLFPVSIPITAAAWYLWEVKKQRAGVLWDVPSPPPVGKAELEDGAYRIKQKGILGYSQIGAGVYKEGTFHTMWHVTRGAVLMHKGKRIEPSWADVRKDLISYGGGWKLEGEWKEGEEVQVLALEPGKNPRAVQTKPGLFKTNTGTIGAVSLDFSPGTSGSPIVDKKGKVVGLYGNGVVTRSGTYVSAIAQTEKSIEDNPEIEDDIFRKRRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYIKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGIKNNQILEENVEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSIATQQPESNILDIDLRPASAWTLYAVATTFITPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLVLCVTQVLMMRTTWALCEALTLATGPISTLWEGNPGRFWNTTIAVSMANIFRGSYLAGAGLLFSIMKNTTNTRRGTGNTGETLGEKWKNRLNALGKSEFQIYKKSGIQEVDRTLAKEGIKRGETDHHAVSRGSAKLRWFVERNLVTPEGKVVDLGCGRGGWSYYCGGLKNVREVKGLTKGGPGHEEPIPMSTYGWNLVRLQSGVDVFFTPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESETPNLDIIGKRIEKIKQEHETSWHYDQDHPYKTWAYHGSYETKQTGSASSMVNGVVRLLTKPWDVIPMVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMGAQLIRQMEGEEVFKGIQHLTATEEIAVQNWLARVGRERLSRMAISGDDCVVKPLDDRFASALTALNDMGKVRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHARHEWMTTEDMLTVWNRVWIQENPWMEDKTPVESWEEIPYLGKREDQWCGSLIGLTSRATWAKNIQTAINQVRSLIGNEEYTDYMPSMKRFRREEEEAGVLW

SEQ ID NO: 3916 - protein, 3291 aa, Artificial Sequence
  derived and/or modified protein sequence (wt) from DENV-2__GQ252676__SS-prME
TAGVIIMLIPTAMAFHLTTRNGEPHMIVSKQEKGKSLLFKTEEGVNMCTLMAMDLGELCEDTITYNCPLLRQNEPEDIDCWCNSTSTWVTYGTCTATGEHRREKRSVALVPHVGMGLETRTETWMSSEGAWKHAQRIETWILRHPGFTIMAAILAYTIGTTYFQRVLIFILLTAVAPSMTMRCIGISNRDFVEGVSGGSWVDIVLEHGSCVTTMAKNKPTLDFELIKTEAKQPATLRKYCIEAKLTNTTTASRCPTQGEPSLNEEQDKRFVCKHSMVDRGWGNGCGLFGKGGIVTCAMFTCKKNMEGKIVQPENLEYTIVVTPHSGEENAVGNDTGKHGKEIKVTPQSSITEAELTGYGTVTMECSPRTGLDFNEMVLLQMENKAWLVHRQWFLDLPLPWLPGADIQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVVRVQYEGDGSPCKIPFEIMDLEKRHVLGRLITVNPIVTEKDSPVNIEAEPPFGDSYIIIGVEPGQLKLSWFKKGSSIGQMFETTMRGAKRMAILGDTAWDFGSLGGVFTSIGKALHQVFGAIYGAAFSGVSWTMKILIGVVITWIGMNSRSTSLSVSLVLVGVVTLYLGVMVQADSGCVVSWKNKELKCGSGIFITDNVHTWTEQYKFQPESPSKLASAIQKAHEEGICGIRSVTRLENLMWKQITPELNHILSENEVKLSIMTGDIKGIMQAGKRSLRPQPTELKYSWKTWGKAKMLSTEPHNQTFLIDGPETAECPNTNRAWNSLEVEDYGFGVFTTNIWLKLKERQDVFCDSKLMSAAIKDNRAVHADMGYWIESALNDTWKIEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAVLLVAVSFMTLITGNMSFRDLGRVMVMVGAAMTDDIGMGVTYLALLAAFKVRPTFAAGLLLRKLTSKELMMTTIGIVLLSQSTIPETILELTDALALGMMILKIVRNMEKYQLAVTIMAILCVPNAVILQNAWKVSCTILAAVSVSPLLLTSSQQKADWIPLALTIKGLNPTAIFLTTLSRTNKKRSWPLNEAIMAVGMVSILASSLLKNDIPMTGPLVAGGLLTVCYVLTGRSADLELERAADVRWEDQAEISGSSPILSITISEDGSMSIKNEEEEQTLTILIRTGLLVISGLFPVSIPITAAAWYLWEVKKQRAGVLWDVPSPPPVGKAELEDGAYRIKQKGILGYSQIGAGVYKEGTFHTMWHVTRGAVLMHKGKRIEPSWADVRKDLISYGGGWKLEGEWKEGEEVQVLALEPGKNPRAVQTKPGLFKTNTGTIGAVSLDFSPGTSGSPIVDKKGKVVGLYGNGVVTRSGTYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYIKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGIKNNQILEENVEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDFGLGSIATQQPESNILDIDLRPASAWTLYAVATTFITPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLVLCVTQVLMMRTTWALCEALTLATGPISTLWEGNPGRFWNTTIAVSMANIFRGSYLAGAGLLFSIMKNTTNTRRGTGNTGETLGEKWKNRLNSLGKSEFQIYKRSGIQEVDRTLAKEGIKRGETDHHAVSRGSAKLRWFVERNLVTPEGKVVDLGCGRGGWSYYCGGLKNVREVKGLTKGGPGHEEPIPMSTYGWNLVRLQSGVDVFFTPPEKCDTLLCDIGESSPNPTVEAGRTLRVLNLVENWLNNNTQFCIKVLNPYMPSVIEKMETLQRKYGGALVRNPLSRNSTHEMYWVSNASGNIVSSVNMISRMLINRFTMRHKKATYEPDVDLGSGTRNIGIESETPNLDIIGKRIEKIKQEHETSWHYDQDHPYKTWAYHGSYETKQTGSASSMVNGVVRLLTKPWDVIPMVTQMAMTDTTPFGQQRVFKEKVDTRTQEPKEGTKKLMKITAEWLWKELGKKKTPRMCTREEFARKVRSNAALGAIFTDENKWKSAREAVEDSRFWELVDKERNLHLEGKCETCVYNMMGKREKKIGEFGKAKGSRAIWYMWLGARFLEFEALGFLNEDHWFSRENSLSGVEGEGLHKLGYILREVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMGAQLIRQMEGEGVFKGIQHLTATEEVAVQDWLARVGRERLSRMAISGDDCVVKPLDDRFASALTALNDMGKVRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHARHEWMTTEDMLTVWNRVWIQENPWMEDKTPVESWEEIPYLGKREDQWCGSLIGLTSRATWAKNIQTAINQVRSLIGSEEYTDYMPSMKRFRREEEEAGVLW

SEQ ID NO: 3917 - protein, 3291 aa, Artificial Sequence
  derived and/or modified protein sequence (wt) from DENV-2__GQ252677__SS-prME
TAGVIIMLIPTAMAFHLTTRNGEPHMIVSKQEKGKSLLFKTEEGVNMCTLMAMDLGELCEDTITYNCPLLRQNEPEDIDCWCNSTSTWVTYGTCTATGEHRREKRSVALVPHVGMGLETRTETWMSSEGAWKHAQRIETWILRHPGFTIMAAILAYTIGTTYFQRVLIFILLTAVAPSMTMRCIGISNRDFVEGVSGGSWVDIVLEHGSCVTTMAKNKPTLDFELIKTEAKQPATLRKYCIEAKLTNTTTASRCPTQGEPSLNEEQDKRFVCKHSMVDRGWGNGCGLFGKGGIVTCAMFTCKKNMEGKIVQPENLEYTIVVTPHSGEENAVGNDTGKHGKEIKVTPQSSITEAELTGYGTVTMECSPRTGLDFNEMVLLQMENKAWLVHRQWFLDLPLPWLPGADIQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVVRVQYEGDGSPCKIPFEIMDLEKRHVLGRLITVNPIVTEKDSPVNIEAEPPFGDSYIIIGVEPGQLKLSWFKKGSSIGQMFETTMRGAKRMAILGDTAWDFGSLGGVFTSIGKALHQVFGAIYGAAFSGVSWTMKILIGVVITWIGMNSRSTSLSVSLVLVGVVTLYLGVMVQADSGCVVSWKNKELKCGSGIFITDNVHTWTEQYKFQPESPSKLASAIQKAHEEGICGIRSVTRLENLMWKQITPELNHILSENEVKLSIMTGDIKGIMQAGKRSLRPQPTELKYSWKTWGKAKMLSTEPHNQTFLIDGPETAECPNTNRAWNSLEVEDYGFGVFTTNIWLKLKERQDVFCDSKLMSAAIKDNRAVHADMGYWIESALNDTWKIEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAVLLVAVSFMTLITGNMSFRDLGRVMVMVGAAMTDDIGMGVTYLALLAAFKVRPTFAAGLLLRKLTSKELMMTTIGIVLLSQSTIPETILELTDALALGMMILKIVRNMEKYQLAVTIMAILCVPNAVILQNAWKVSCTILAAVSVSPLLLTSSQQKADWIPLALTIKGLNPTAIFLTTLSRTNKKRSWPLNEAIMAVGMVSILASSLLKNDIPMTGPLVAGGLLTVCYVLTGRSADLELERAADVRWEDQAEISGSSPILSITISEDGSMSIKNEEEEQTLTILIRTGLLVISGLFPVSIPITAAAWYLWEVKKQRAGVLWDVPSPPPVGKAELEDGAYRIKQKGILGYSQIGAGVYKEGTFHTMWHVTRGAVLMHKGKRIEPSWADVRKDLISYGGGWKLEGEWKEGEEVQVLALEPGKNPRAVQTKPGLFKTNTGTIGAVSLDFSPGTSGSPIVDKKGKVVGLYGNGVVTRSGTYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYIKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGIKNNQILEENVEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDFGLGSIATQQPESNILDIDLRPASAWTLYAVATTFITPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLVLCVTQVLMMRTTWALCEALTLATGPISTLWEGNPGRFWNTTIAVSMANIFRGSYLAGAGLLFSIMKNTTNTRRGTGNTGETLGEKWKNRLNSLGKSEFQIYKRSGIQEVDRTLAKEGIKRGETDHHAVSRGSAKLRWFVERNLVTPEGKVVDLGCGRGGWSYYCGGLKNVREVKGLTKGGPGHEEPIPMSTYGWNLVRLQSGVDVFFTPPEKCDTLLCDIGESSPNPTVEAGRTLRVLNLVENWLNNNTQFCIKVLNPYMPSVIEKMETLQRKYGGALVRNPLSRNSTHEMYWVSNASGNIVSSVNMISRMLINRFTMRHKKATYEPDVDLGSGTRNIGIESETPNLDIIGKRIEKIKQEHETSWHYDQDHPYKTWAYHGSYETKQTGSASSMVNGVVRLLTKPWDVIPMVTQMAMTDTTPFGQQRVFKEKVDTRTQEPKEGTKKLMKITAEWLWKELRKKKTPRMCTREEFARKVRSNAALGAIFTDENKWKSAREAVEDSRFWELVDKERNLHLEGKCETCVYNMMGKREKKIGEFGKAKGSRAIWYMWLGARFLEFEALGFLNEDHWFSRENSLSGVEGEGLHKLGYILREVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMGAQLIRQMEGEGVFKGIQHLTATEEVAVQDWLARVGRERLSRMAISGDDCVVKPLDDRFASALTALNDMGKVRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHARHEWMTTEDMLTVWNRVWIQENPWMEDKTPVESWEEIPYLGKREDQWCGSLIGLTSRATWAKNIQTAINQVRSLIGSEEYTDYMPSMKRFRREEEEAGVLW

SEQ ID NO: 3918 - protein, 3291 aa, Artificial Sequence
  derived and/or modified protein sequence (wt) from DENV-2__FJ898438__SS-prME
TVGVIVMLIPTAMAFHLTTRNGEPHMIVGRQEKGKSLLFKTEDGVNMCTLMAIDLGELCEDTITYKCPLLRQNEPEDIDCWCNSTSTWVTYGTCSTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVQPENFEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEITDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNSNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRIGTKHAILLVAASFVTLITGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAVMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVGKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGIFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIKTEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRKWCFDGIKNNQILEENMEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMETLQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDGRFWELVDRERNLHLEGKCETCVYNMMGKREKKLGEFGKAKGSRAIWYMWLGARFLEFEALGFLNEDHWFSRGNSLSGVEGEGLHRLGYILRDVGKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKSIQHLTATEEIAVQNWLARVGRERLSRMAISGDDCVVKPIDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 3919 - protein, 3291 aa, Artificial Sequence
  derived and/or modified protein sequence (wt) from DENV-2__GQ199893__SS-prME
TAGVIVMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQKALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVQPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEITDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDLCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRIGTKHAILLVAVSFVTLITGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVEKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGIFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIKTEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRKWCFDGIKNNQILEENIEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQVYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMEALQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDGRFWELVDRERNLHLEGKCETCVYNMMGKREKKLGEFGKAKGSRAIWYMWLGARFLEFEALGFLNEDHWFSRGNSLSGVEGEGLHRLGYILRDVGKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKSIQHLTATEEIAVQNWLARVGRERLSRMAISGDDCVVKPIDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPPHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 3920 - protein, 3291 aa, Artificial Sequence
  derived and/or modified protein sequence (wt) from DENV-2__GQ199894__SS-prME
TAGVIVMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQKALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVQPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEITDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKHFAGPVSQHNYRPGYHTQTAGPWHLGKLEMDFDLCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRIGTKHAILLVAASFVTLITGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVEKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGIFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIKTEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRKWCFDGIKNNQILEENIEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQVYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMEALQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDGRFWELVDRERNLHLEGKCETCVYNMMGKREKKLGEFGKAKGSRAIWYMWLGARFLEFEALGFLNEDHWFSRGNSLSGVEGEGLHRLGYILRDVGKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKSIQHLTATEEIAVQNWLARVGRERLSRMAISGDDCVVKPIDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPPHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 3921 - protein, 3291 aa, Artificial Sequence
  derived and/or modified protein sequence (wt) from DENV-2__FJ898439__SS-prME
TAGVIVMLIPTAMAFHLTTRNGEPHMIVGRQEKGKSLLFKTEDGVNMCTLMAIDLGELCEDTITYKCPLLRQNEPEDIDCWCNSTSTWVTYGTCSTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVQPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEITDLEKRHVLGRLITVNPIVTGKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDLCEGTTVVVTEDCGNRGPSLRTTTASGKLITEWCCRSCTLPPLRYRGEDGCWYGMEIRPLKEKEENLVNSLVTAGHGQVDNFSLGVLGMALFLEEMLRTRIGTKHAILLVAASFVTLITGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAVMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVEKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGIFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIKTEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRKWCFDGIKNNQILEENMEVEIWTKEGERKKLKPRWLDARIYSDPLALKEFKEFAAGRKSLTLNLITEMGRLPTFMTQKARNALDNLAVLHTAETGGKAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGFGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIVGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMETLQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKRKTPRMCTREEFTRKVRSNAALGAIFTDENKWKSAREAVEDGRFWELVDRERNLHLEGKCETCVYNMMGKREKKLGEFGKAKGSRAIWYMWLGARFLEFEALGFLNEDHWFSRGNSLSGVEGEGLHRLGYILRDVGKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKSIQHLTATEEVAVQNWLARVGRERLSRMAISGDDCVVKPIDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 3922 - protein, 3291 aa, Artificial Sequence
  derived and/or modified protein sequence (wt) from DENV-2__GQ868588__SS-prME
TAGMIIMLIPTVMAFHLTTRNGEPHMIVSRQEKGKSLLFKTKDGTNMCTLMALDLGELCEDTITYKCPFLKQNEPEDIDCWCNSTSTWVTYGTCTTTGEHRREKRSVALVPHVGMGLETRTETWMSSEGAWKHAQRIETWILRHPGFTIMAAILAYTIGTTHFQRVLIFILLTAIAPSMAMRCIGISNRDFVEGVSGGSWVDIVLEHGSCVTTMAKNKPTLDFELIKTEAKQPATLRKYCIEAKLTNTTTDSRCPTQGEPTLNEEQDKRFVCKHSMVDRGWGNGCGLFGKGGIVTCAMFTCKKNMEGKIVQPENLEYTVVITPHSGEEHAVGNDTGKHGKEVKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEIMDLEKRHVLGRLITVNPIVTEKDSPVNIEAEPPFGDSYIIIGVEPGQLKLDWFRKGSSIGQMFETTMRGAKRMAILGDTAWDFGSLGGVFTSIGKALHQVFGAIYGAAFSGVSWTMKILIGVIITWIGMNSRSTSLSVSLVLVGIVTLYLGVMVQADSGCVVSWKNKELKCGSGIFVTDNVHTWTEQYKFQPESPSKLASAIQKAHEEGICGIRSVTRLENLMWKQITSELNHILSENEVKLTIMTGDIKGIMQVGKRSLRPQPTELRYSWKTWGKAKMLSTELHNQTFLIDGPETAECPNTNRAWNSLEVEDYGFGVFTTNIWLRLREKQDVFCDSKLMSAAIKDNRAVHADMGYWIESALNDTWKIEKASFIEVKSCHWPKSHTLWSNGVLESEMVIPKNFAGPVSQHNNRPGYHTQTAGPWHLGKLEMDFDFCEGTTVVVTEECGNRGPSLRTTTASGKLITEWCCRSCTLPPLRYRGEDGCWYGMEIRPLKEKEENLVSSLVTAGHGQIDNFSLGILGMALFLEEMLRTRVGTKHAILLVAVSFVTLITGNMSFRDLGRVMVMVGATMTDDIGMGVTYLALLAAFKVRPTFAAGLLLRKLTSKELMMTTIGIVLLSQSSIPETILELTDALALGMMVLKMVRNMEKYQLAVTIMAILCVPNAVILQNAWKVSCTILAVVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERATDVKWDDQAEISGSSPILSITISEDGSMSIKNEEEEQTLTILIRTGLLVISGLFPVSIPITAAAWYLWEVKKQRAGVLWDIPSPPPVGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFRTNTGTIGAVSLDFSPGTSGSPIVDKKGKVVGLYGNGVVTRSGAYVSAIAQTEKSIEDNPEIEDDIFRKRRLTIMDLHPGAGKTKKYLPAIVREAIKRGLRTLILAPTRVVAAEMEEALRGLPIRYQTPAIRAEHTGREIVDLMCHATFTMRLLSPIRVPNYNLIIMDEAHFTDPASIAARGYISTRVEMGEAAGIFMTATPPGSRDPFPQSNAPIMDEEREIPERSWNSGHEWVTDFKGKTVWFVPSIKTGNDIAACLRKNGKRVIQLSRKTFDSEYVKTRTNDWDFVVTTDISEMGANFKAERVIDPRRCMKPVILTDGEERVILAGPMPVTHSSAAQRRGRIGRNPRNENDQYIYMGEPLENDEDCAHWKEAKMLLDNINTPEGIIPSMFEPEREKVDAIDGEYRLRGEARKTFVDLMRRGDLPVWLAYKVASEGINYADRRWCFDGTRNNQILEENVEVEIWTKEGERKKLKPRWLDARIYSDPLALKEFKEFAAGRKSLTLNLITEMGRLPTFMTQKARDALDNLAVLHTAEAGGKAYNHALSELPETLETLLLLTLLATVTGGIFLFLMSGRGIGKMTLGMCCIITASILLWYAQIQPHWIAASIILEFFLIVLLIPEPEKQRTPQDNQLTYVIIAILTVVAATMANEMGFLEKTKKDLGLGHIATQQPESNILDIDLRPASAWTLYAVATTFITPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLVLCVTQVLMMRTTWALCEALTLATGPVSTLWEGNPGRFWNTTIAVSMANIFRGSYLAGAGLLFSIMKNTTSTRRGTGNIGETLGEKWKSRLNALGKSEFQIYKKSGIQEVDRTLAKEGIKRGETDHHAVSRGSAKLRWFVERNLVTPEGKVVDLGCGRGGWSYYCGGLKNVREVKGLTKGGPGHEEPIPMSTYGWNLVRLQSGVDVFFVPPEKCDTLLCDIGESSPNPTVEAGRTLRVLNLVENWLNNNTQFCVKVLNPYMPSVIERMETLQRKYGGALVRNPLSRNSTHEMYWVSNASGNIVSSVNMISRMLINRFTMRHKKATYEPDVDLGSGTRNIGIESETPNLDIIGKRIEKIKQEHEASWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTKKVRSNAALGAIFTDENKWKSAREAVEDNRFWELVDKERNLHLEGKCETCIYNMMGKREKKLGEFGKAKGSRAIWYMWLGARFLEFEALGFLNEDHWFSRENSLSGVEGEGLHKLGYILREVSKKEGGAMYADDTAGWDTRITIEDLKNEEMITNHMAGEHKKLAEAIFKLTYQNKVVRVQRPTPRGTVMDIISRRDQRGSGQVGTYGLNTFTNMEAQLIRQMEGEGIFKSIQHLTASEEIAVQDWLVRVGRERLSRMAISGDDCVVKPLDDRFARALTALNDMGKVRKDIQQWEPSRGWNDWTQVPFCSHHFHELIMKDGRILVVPCRNQDELIGRARISQGAGWSLRETACLGKSYAQMWSLMYFHRRDLRLAANAICSAVPSHWVPTSRTTWSIHASHEWMTTEDMLTVWNRVWILENPWMEDKTPVESWEEIPYLGKREDQWCGSLIGLTSRATWAKNIQTAINQVRSLIGNEEYTDYMPSMKRFRREEEEAGVLW

SEQ ID NO: 3923 - protein, 3291 aa, Artificial Sequence
  derived and/or modified protein sequence (wt) from DENV-2__GQ868590__SS-prME
TAGMIIMLIPTVMAFHLTTRNGEPHMIVSRQEKGKSLLFKTKDGTNMCTLMAMDLGELCEDTITYKCPFLKQNEPEDIDCWCNSTSTWVTYGTCTTTGEHRREKRSVALVPHVGMGLETRTETWMSSEGAWKHAQRIETWILRHPGFTIMAAILAYTIGTTHFQRVLIFILLTAIAPSMTMRCIGISNRDFVEGVSGGSWVDIVLEHGSCVTTMAKNKPTLDFELIKTEAKQPATLRKYCIEAKLTNTTTDSRCPTQGEPTLNEEQDKRFVCKHSMVDRGWGNGCGLFGKGGIVTCAMFTCKKNMEGKIVQPENLEYTVVITPHSGEEHAVGNDTGKHGKEVKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEIMDLEKRHVLGRLITVNPIVTEKDSPVNIEAEPPFGDSYIIIGVEPGQLKLDWFKKGSSIGQMFETTMRGAKRMAILGDTAWDFGSLGGMFTSIGKALHQVFGAIYGAAFSGVSWTMKILIGVIITWIGMNSRSTSLSVSLVLVGIVTLYLGVMVQADSGCVVSWKNKELKCGSGIFVTDNVHTWTEQYKFQPESPSKLASAIQKAHEEGICGIRSVTRLENLMWKQITPELNHILSENEVKLTIMTGDTKGIMQVGKRSLRPQPTELRYSWKTWGKAKMLPTELHNQTFLIDGPETAECPNTNRAWNSLEVEDYGFGVFTTNIWLRLREKQDVFCDSKLMSAAIKDNRAVHADMGYWIESALNDTWKIEKASFIEVKSCHWPKSHTLWSNGVLESEMVIPKNLAGPVSQHNNRPGYHTQTAGPWHLGKLEMDFNFCEGTTVVVTEECGNRGPSLRTTTASGKLITEWCCRSCTLPPLRYRGEDGCWYGMEIRPLKEKEENLVSSLVTAGHGQIDNFSLGILGMALFLEEMLRTRVGTKHAILLVAVSFVTLITGNMSFRDLGRVMVMVGATMTDDIGMGVTYLALLAAYKVRPTFAAGLLLRKLTSKELMMTTIGIVLLSQSSIPETILELTDALALGMMVLKMVRNMEKYQLAVTIMAILCVPNAVILQNAWKVSCTILAVVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELEKATDVKWDDQAEISGSSPILSITISEDGSMSIKNEEEEQTLTILIRTGLLVISGLFPVSIPITAAAWYLWEVKKQRAGVLWDVPSPPPVGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFRTNTGTIGAVSLDFSPGTSGSPIVDKKGKVVGLYGNGVVTRSGAYVSAIAQTEKSIEDNPEIEDDIFRKRRLTIMDLHPGAGKTKKYLPAIVREAIKRGLRTLILAPTRVVAAEMEEALRGLPIRYQTPAIRAEHTGREIVDLMCHATFTMRLLSPIRVPNYNLIIMDEAHFTDPASIAARGYISTRVEMGEAAGIFMTATPPGSRDPFPQSNAPIMDEEREIPERSWNSGHEWVTDFKGKTVWFVPSIKTGNDIAACLRKNGKRVIQLSRKTFDSEYVKTRTNDWDFVVTTDISEMGANFKAERVIDPRRCMKPVILTDGEERVILAGPMPVTHSSAAQRRGRIGRNPRNENDQYIYMGEPLENDEDCAHWKEAKMLLDNINTPEGIIPSMFGPEREKVDAIDGEYRLRGEARKTFVELMRRGDLPVWLAYKVASEGINYADRRWCFDGTRNNQILEENVEVEIWTKEGERKKLKPRWLDARIYSDPLALKEFKEFAAGRKSLTLNLITEMGRLPTFMTQKARDALDNLAVLHTAEAGGKAYNHALSELPETLETLLLLTLLATVTGGIFLFLMSGRGIGKMTLGMCCIITASILLWYAQIQPHWIAASIILEFFLIVLLIPEPEKQRTPQDNQLTYVIIAILTVVAATMANEMGFLEKTKKDLGLGHIATQQPESNILDIDLRPASAWTLYAVATTFITPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLVLCVTQVLMMRTTWALCEALTLATGPVSTLWEGNPGRFWNTTIAVSMANIFRGSYLAGAGLLFSIMKNTTSTRRGTGNIGETLGEKWKSRLNALGKSEFQIYKKSGIQEVDRTLAKEGIKRGETDHHAVSRGSAKLRWFVERNLVTPEGKVVDLGCGRGGWSYYCGGLKNVREVKGLTKGGPGHEEPIPMSTYGWNLVRLQSGVDVFFIPPEKCDTLLCDIGESSPNPTVEAGRTLRVLNLVESWLNNNTQFCVKVLNPYMPSVIERMETLQRKYGGALVRNPLSRNSTHEMYWVSNASGNVVSSVNMISRMLINRFTMRHKKATYEPDVDLGSGTRNIGIESETPNLDIIGKRIEKIKQEHEASWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTKKVRSNAALGAIFTDENKWKSAREAVEDNRFWELVDKERNLHLEGKCETCVYNMMGKREKKLGEFGKAKGSRAIWYMWLGARFLEFEALGFLNEDHWFSRENSLSGVEGEGLHKLGYILREVSKKEGGAMYADDTAGWDTRITIEDLKNEEMITNHMAGEHKKLAEAIFKLTYQNKVVRVQRPTPIGTVMDIISRRDQRGSGQVGTYGLNTFTNMEAQLIRQMEGEGIFKSIQHLTASEEIAVQDWLVRVGRERLSRMAISGDDCVVKPLDDRFARALTALNDMGKVRKDIQQWEPSRGWNDWTQVPFCSHHFHELIMKDGRTLVVPCRNQDELIGRARISQGAGWSLRETACLGKSYAQMWSLMYFHRRDLRLAANAICSAVPSHWVPTSRTTWSIHASHEWMTTEDMLTVWNRVWILENPWMEDKTPVESWEEIPYLGKREDQWCGSLIGLTSRATWAKNIQTAINQVRSLIGNEEYTDYMPSMKRFRREEEEAGVLW

SEQ ID NO: 3924 - protein, 3291 aa, Artificial Sequence
  derived and/or modified protein sequence (wt) from DENV-2__GQ868497__SS-prME
TASVIVMLIPTVMAFHLTTRNGEPHMIVGRQEKGKSLLFKTEDGVNMCTLMAIDLGELCEDTITYKCPLLRQNEPEDIDCWCNSTSTWVTYGTCSTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVMQPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEITDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRIGTKHAILLVAASFVTLITGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAVMAVGMVSILASSLLKNDIPMTGPLVAGGLLTVCYVLTGRSADLELERAADVKWEDQAEISGSSPILSITISEDGSMSVKNEEEEQTLTILIRTGLLVISGVFPVSIPITAAAWYLWEVKKQRAGVLWDVPSPPPVEKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGIFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIKTEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRKWCFDGIKNNQILEENMEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKDVREVKGLTKGGPGHEEPIPMSTYGWNLVRLQSGIDVFFTPPEKCDTLLCDIGESSPNPTIEAGRTLRVLNLVENWLNNNTQFCIKVLNPYMPSVIEKMETLQRKYGGALVRNPLSRNSTHEMYWVSNATGNIVSSVNMISRMLINRFTMKHKKATYEPDVDLGSGTRNIGIESEIPNLDIIGKRIEKIKREHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDGRFWELVDRERNLHLEGKCETCVYNMMGKREKKLGEFGKAKGSRAIWYMWLGARFLEFEALGFLNEDHWFSRGNSLSGVEGEGLHRLGYILRDVGKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKSIQHLTATEEIAVQNWLARVGRERLSRMAISGDDCVVKPIDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRKEEEEAGVLW

SEQ ID NO: 3925 - protein, 3291 aa, Artificial Sequence
  derived and/or modified protein sequence (wt) from DENV-2__GU131959__SS-prME
TAGVIVMLIPTVMAFHLTTRNGEPHMIVGRQEKGKSLLFKTEDGVNMCTLMAIDLGELCEDTITYKCPLLRQNEPEDIDCWCNSTSTWVTYGTCSTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVQPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEITDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNTRSTSLSVSLVLVGVVTLYLGAMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNETWKMEKASFIEVKSCYWPKSHTLWSNGVLESEMIIPKNFAGPVSQHNYRPGYHTQTAGPWHLGKLEMDFDLCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRIGTKHAILLVAASFVTLITGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAVMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVEKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGIFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIKTEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRKWCFDGIKNNQILEENMEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKDVREVKGLTKGGPGHEEPIPMSTYGWNLVRLQSGIDVFFTPPEKCDTLLCDIGESSPNPTIEAGRTLRVLNLVENWLNNNTQFCIKVLNPYMPSVIEKMETLQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDGRFWELVDRERNLHLEGKCETCVYNMMGKREKKLGEFGKAKGSRAIWYMWLGARFLEFEALGFLNEDHWFSRGNSLSGVEGEGLHRLGYILRDVGKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKSIQHLTATEEIAVQNWLARVGRERLSRMAISGDDCVVKPIDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRKEEEEAGVLW

SEQ ID NO: 3926 - protein, 3291 aa, Artificial Sequence
  derived and/or modified protein sequence (wt) from DENV-2__GQ868515__SS-prME
TAGVIVMLIPTVMAFHLTTRNGEPHMIVGRQEKGKSLLFKTEDGVNMCTLMAIDLGELCEDTITYKCPLLRQNEPEDIDCWCNSTSTWITYGTCSTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVQPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVRYEGDGSPCKIPFEITDSEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVILYLGAMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDLCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRIGTKHAILLVAASFVTLITGNMSFRDLGRVMVMVGATMTDDIGMGVTYLALLAAFKVRPTFAAGLLLRKLTSKELMMATIGIALLSQSTIPESILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAVMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVEKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGIFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIKTEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRKWCFDGIKNNQILEENMEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKDVREVKGLTKGGPGHEEPIPMSTYGWNLVRLQSGIDVFFTPPEKCDTLLCDIGESSPNPTIEAGRTLRVLNLVENWLNNNTQFCIKVLNPYMPSVIEKMETLQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDGRFWELVDRERNLHLEGKCETCVYNMMGKREKKLGEFGKAKGSRAIWYMWLGARFLEFEALGFLNEDHWFSRGNSLSGVEGEGLHRLGYILRDVGKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKNIQHLTATEEIAVQNWLARVGRERLSRMAISGDDCVVKPIDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRKEEEEAGVLW

SEQ ID NO: 3927 - protein, 3291 aa, Artificial Sequence
  derived and/or modified protein sequence (wt) from DENV-2__GQ868516__SS-prME
TAGVIVMLIPTVMAFHLTTRNGEPHMIVGRQEKGKSLLFKTEDGVNMCTLMAIDLGELCEDTITYKCPLLRQNEPEDIDCWCNSTSTWITYGTCSTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVQPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEITDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVILYLGAMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDLCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRIGTKHAILLVAASFVTLITGNMSFRDLGRVMVMVGATMTDDIGMGVTYLALLAAFKVRPTFAAGLLLRKLTSKELMMATIGIALLSQSTIPESILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAVMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVEKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGIFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIKTEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRKWCFDGIKNNQILEENMEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKDVREVKGLTKGGPGHEEPIPMSTYGWNLVRLQSGIDVFFTPPEKCDTLLCDIGESSPNPTIEAGRTLRVLNLVENWLNNNTQFCIKVLNPYMPSVIEKMETLQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDGRFWELVDRERNLHLEGKCETCVYNMMGKREKKLGEFGKAKGSRAIWYMWLGARFLEFEALGFLNEDHWFSRGNSLSGVEGEGLHRLGYILRDVGKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKNIQHLTATEEIAVQNWLARVGRERLSRMAISGDDCVVKPIDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRKEEEEAGVLW

SEQ ID NO: 3928 - protein, 3291 aa, Artificial Sequence
  derived and/or modified protein sequence (wt) from DENV-2__GU131975__SS-prME
TAGVIVMLIPTVMAFHLTTRNGEPHMIVGRQEKGKSLLFKTEDGVNMCTLMAIDLGELCEDTITYKCPLLRQNEPEDIDCWCNSTSTWITYGTCSTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVQPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEITDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVILYLGAMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDLCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRIGTKHAILLVAASFVTLITGNMSFRDLGRVMVMVGATMTDDIGMGVTYLALLAAFKVRPTFAAGLLLRKLTSKELMMATIGIALLSQSTIPESILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAVMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVEKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGIFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIKTEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRKWCFDGIKNNQILEENMEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKDVREVKGLTKGGPGHEEPIPMSTYGWNLVRLQSGIDVFFTPPEKCDTLLCDIGESSPNPTIEAGRTLRVLNLVENWLNNNTQFCIKVLNPYMPSVIEKMETLQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDGRFWELVDRERSLHLEGKCETCVYNMMGKREKKLGEFGKAKGSRAIWYMWLGARFLEFEALGFLNEDHWFSRGNSLSGVEGEGLHRLGYILRDVGKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKNIQHLTATEEIAVQNWLARVGRERLSRMAISGDDCVVKPIDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRKEEEEAGVLW

SEQ ID NO: 3929 - protein, 3291 aa, Artificial Sequence
  derived and/or modified protein sequence (wt) from DENV-2__JN819422__SS-prME
TAGVIVMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQKALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVQPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEITDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDLCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRIGTKHAILLVAVSFVTLITGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVEKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGIFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIKTQHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRKWCFDGIKNNQILEENIEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGVGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQVYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMEALQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDGRFWELVDRERNLHLEGKCETCVYNMMGKREKKLGEFGKAKGSRAIWYMWLGARFLEFEALGFLNEDHWFSRGNSLSGVEGEGLHRLGYILRDVGKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKSIQHLTATEEIAVQNWLARVGRERLSRMAISGDDCVVKPIDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPPHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 3930 - protein, 3291 aa, Artificial Sequence
  derived and/or modified protein sequence (wt) from DENV-2__GU131955__SS-prME
TAGVIVMLIPTVMAFHLTTRNGEPHMIVGRQEKGKSLLFKTEDGVNMCTLMAIDLGELCEDTITYKCPLLRQNEPEDIDCWCNSTSTWVTYGTCSTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVQPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEITDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDLCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRIGTKHAILLVAASFVTLITGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAVMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVEKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGIFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIKTEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRKWCFDGIKNNQILEENMEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKDVREVKGLTKGGPGHEEPIPMSTYGWNLVRLQSGIDVFFTPPEKCDTLLCDIGESSPNPTIEAGRTLRVLNLVENWLNNNTQFCIKVLNPYMPSVIEKMETLQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDGRFWELVDRERNLHLEGKCETCVYNMMGKREKKLGEFGKAKGSRAIWYMWLGARFLEFEALGFLNEDHWFSRGNSLSGVEGEGLHRLGYILRDVGKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKSIQHLTATEEIAVQNWLARVGRERLSRMAISGDDCVVKPIDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRKEEEEAGVLW

SEQ ID NO: 3931 - protein, 3291 aa, Artificial Sequence
  derived and/or modified protein sequence (wt) from DENV-2__KJ189311__SS-prME
TAGVIVMLIPTVMAFHLTTRNGEPHMIVGRQEKGKSLLFKTEDGVNMCTLMAIDLGELCEDTITYKCPLLRQNEPEDIDCWCNSTSTWITYGTCSTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVQPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEITDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVILYLGAMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDLCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRIGTKHAILLVAASFVTLITGNMSFRDLGRVMVMVGATMTDDIGMGVTYLALLAAFKVRPTFAAGLLLRKLTSKELMMATIGIALLSQSTIPESILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAVMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVEKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGIFKTNTGTIGAVSLDFSPGTSGSPIVDRKGKVVGLYGNGVVTRSGAYVSAIAQTEKSIEDNLEIEDDIFRKKRLTIMDLHPGAGKTKRYLPAIVREAIKRGLRTLILAPTRVVAAEMEEALRGLPIRYQTPAIKTEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRKWCFDGIKNNQILEENMEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKDVREVKGLTKGGPGHEEPIPMSTYGWNLVRLQSGIDVFFTPPEKCDTLLCDIGESSPNPTIEAGRTLRVLNLVENWLNNNTQFCIKVLNPYMPSVIEKMETLQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDGRFWELVDRERSLHLEGKCETCVYNMMGKREKKLGEFGKAKGSRAIWYMWLGARFLEFEALGFLNEDHWFSRGNSLSGVEGEGLHRLGYILRDVGKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKNIQHLTATEEIAVQNWLARVGRERLSRMAISGDDCVVKPIDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRKEEEEAGVLW

SEQ ID NO: 3932 - protein, 3291 aa, Artificial Sequence
  derived and/or modified protein sequence (wt) from DENV-2__KJ189370__SS-prME
TAGVIVMLIPTAMAFHLTTRNGEPHMIVSRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVQPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEITDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLKEKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDLCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRIGTKHAILLVAVSFVTLITGNMSFRDLGRVMVMVGATMTDDIGMGVTYLALLAAFKVRPTFAAGLLLRKLTSKELMMATIGIALLSQSTIPETILELTDALALGMMVLKVVRNMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVEKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGIFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIKAEYTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRKWCFDGIKNNQILEENMEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFLTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLILCVTQVLMMRTTWALCEALTLATGPISTLWEGNPGRFWNTTIAVSMANIFRGSYLAGAGLLFSIMKNTTSTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMEALQRKYGGALVRNPLSRNSTHEMYWVSNATGNIVSSVNMISRMLINRFTMKHKKATYEPDVDLGSGTRNIGIESEVPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDGRFWELVDRERNLHLEGKCETCVYNMMGKREKKLGEFGKAKGSRAIWYMWLGARFLEFEALGFLNEDHWFSRGNSLSGVEGEGLHRLGYILREVGKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKSIQHLTATEEIAVQNWLVRVGRERLSRMAISGDDCVVKPIDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 3933 - protein, 3291 aa, Artificial Sequence
  derived and/or modified protein sequence (wt) from DENV-2__EU482620__SS-prME
TAGVIVMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVQPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEITDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAVVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRIGTKHAILLVAVSFVTLITGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVEKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGIFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIKTEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYTDRKWCFDGIKNNQILEENMEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTSTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMEALQRQYGGALVRNPLSRNSTHEMYWVSNATGNIVSSVNMISRMLINRFTMKHKKATYEPDVDLGSGTRNIGIESEIPNLDIIGKRIEKIKQEHEISWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDGRFWELVDRERNLHLEGKCETCVYNMMGKREKKLGEFGKAKGSRAIWYMWLGARFLEFEALGFLNEDHWFSRGNSLSGVEGEGLHRLGYILRDVGKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKSIQHLTATEEIAVQNWLARVGRERLSRMAISGDDCVVKPIDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 3934 - protein, 3291 aa, Artificial Sequence
  derived and/or modified protein sequence (wt) from DENV-2__FJ373300__SS-prME
TAGVIVMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVQPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEITDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAVVQADSGCVVSWKNKELKCGSGIFITDNVHTWTEQYKFQPESPSKLASAIQKAHEEGICGIRSVTRLENLMWKQITPELNHILSENEVKLTIMTGDIKGTMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRIGTKHAILLVAVSFVTLITGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLAVTIMAISCVPNAVILQNAWKVSCTVLAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVEKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGIFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIKTEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRKWCFDGIKNNQILEENMEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTSTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMEALQRQYGGALVRNPLSRNSTHEMYWVSNATGNIVSSVNMISRMLINRFTMKHKKATYEPDVDLGSGTRNIGIESEIPNLDIIGKRIEKIKQEHEISWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTKKVRSNAALGAIFTDENKWKSAREAVEDGRFWELVDRERNLHLEGKCETCVYNMMGKREKKLGEFGKAKGSRAIWYMWLGARFLEFEALGFLNEDHWFSRGNSLSGVEGEGLHRLGYILRDVGKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKSIQHLTATEEIAVQNWLARVGRERLSRMAISGDDCVVKPIDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 3935 - protein, 3291 aa, Artificial Sequence
  derived and/or modified protein sequence (wt) from DENV-2__EU596495__SS-prME
TAGVIVMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVQPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEITDLEKRHVLGRLITVNPIVTGKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAVVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRIGTKHAILLVAVSFVTLITGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVEKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGIFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIKTEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRKWCFDGIKNNQILEENMEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTSTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMEALQRQYGGALVRNPLSRNSTHEMYWVSNATGNIVSSVNMISRMLINRFTMKHKKATYEPDVDLGSGTRNIGIESEIPNLDIIGKRIEKIKQEHEISWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTKKVRSNAALGAIFTDENKWKSAREAVEDGRFWELVDRERNLHLEGKCETCVYNMMGKREKKLGEFGKAKGSRAIWYMWLGARFLEFEALGFLNEDHWFSRGNSLSGVEGEGLHRLGYILRDVGKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKSIQHLTATEEIAVQNWLARVGRERLSRMAISGDDCVVKPIDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 3936 - protein, 3291 aa, Artificial Sequence
  derived and/or modified protein sequence (wt) from DENV-2__EU596497__SS-prME
TAGVIVMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTITESRCPTQGEPSLNEEQDKRFICKHSMVDRGWGNGCGLFGKGGIVTCAMFTCKKNMEGKVVQPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEITDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAVVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSYTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRIGTKHAILLVAVSFVTLITGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVEKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGIFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIKTEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRKWCFDGIKNNQILEENMEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTSTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMEALQRQYGGALVRNPLSRNSTHEMYWVSNATGNIVSSVNMISRMLINRFTMKHKKATYEPDVDLGSGTRNIGIESEIPNLDIIGKRIEKIKQEHEISWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTKKVRSNAALGAIFTDENKWKSAREAVEDGRFWELVDRERNLHLEGKCETCVYNMMGKREKKLGEFGKAKGSRAIWYMWLGARFLEFEALGFLNEDHWFSRGNSLSGVEGEGLHRLGYILRDVGKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKSIQHLTATEEIAVQNWLARVGRERLSRMAISGDDCVVKPIDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 3937 - protein, 3291 aa, Artificial Sequence
  derived and/or modified protein sequence (wt) from DENV-2__EU569695__SS-prME
TAGVIVMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVQPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEITDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAVVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRIGTKHAILLVAVSFVTLITGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVEKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGIFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIKTEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRKWCFDGIKNNQILEENMEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAVANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTSTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMEALQRQYGGALVRNPLSRNSTHEMYWVSNATGNIVSSVNMISRMLINRFTMKHKKATYEPDVDLGSGTRNIGIESEIPNLDIIGKRIEKIKQEHEISWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTKKVRSNAALGAIFTDENKWKSAREAVEDGRFWELVDRERNLHLEGKCETCVYNMMGKREKKLGEFGKAKGSRAIWYMWLGARFLEFEALGFLNEDHWFSRGNSLSGVEGEGLHRLGYILRDVGKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKSIQHLTATEEIAVQNWLARVGRERLSRMAISGDDCVVKPIDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 3938 - protein, 3291 aa, Artificial Sequence
  derived and/or modified protein sequence (wt) from DENV-2__EU482623__SS-prME
TAGVIVMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVQPENLEYTIVITPHSGEEHAVGNDTGKHGKEIKITPQSSITEAELTGYGTVTMECSPRTGLDFNEMVLLQMEDKAWLVHRQWFLDLPLPWLPGADTQESNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEITDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAVVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALLLEEMLRTRIGTKHAILLVAVSFVTLITGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVEKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGIFKTNSGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIKTEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRAIDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRKWCFDGIKNNQILEENMEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTSTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMEALQRQYGGALVRNPLSRNSTHEMYWVSNATGNIVSSVNMISRMLINRFTMKHKKATYEPDVDLGSGTRNIGIESEIPNLDIIGKRIEKIKQEHEISWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTKKVRSNAALGAIFTDENKWKSAREAVEDGRFWELVDRERNLHLEGKCETCVYNMMGKREKKLGEFGKAKGSRAIWYMWLGARFLEFEALGFLNEDHWFSRGNSLSGVEGEGLHRLGYILRDVGKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKSIQHLTATEEIAVQNWLARVGRERLSRMAISGDDCVVKPIDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 3939 - protein, 3291 aa, Artificial Sequence
  derived and/or modified protein sequence (wt) from DENV-2__EU569698__SS-prME
TAGVIVMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVQPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEITDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAVVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRIGTKHAILLVAVSFVTLITGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVEKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGIFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIKTEHTGREIVDLMCHATFTMRLLSPVRVPNYNLIIMDEAHFTDPASIAARGYISTRVEMGEAAGIFMTATPPGSRDSFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRKWCFDGIKNNQILEENMEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTSTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMEALQRQYGGALVRNPLSRNSTHEMYWVSNATGNIVSSVNMISRMLINRFTMKHKKATYEPDVDLGSGTRNIGIESEIPNLDIIGKRIEKIKQEHEISWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTKKVRSNAALGAIFTDENKWKSAREAVEDGRFWELVDRERNLHLEGKCETCVYNMMGKREKKLGEFGKAKGSRAIWYMWLGARFLEFEALGFLNEDHWFSRGNSLSGVEGEGLHRLGYILRDVGKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKSIQHLTATEEIAVQNWLARVGRERLSRMAISGDDCVVKPIDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 3940 - protein, 3291 aa, Artificial Sequence
  derived and/or modified protein sequence (wt) from DENV-2__EU569699__SS-prME
TAGVIVMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAKFTCKKNMEGKVVQPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEITDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAMVQADSGCVVSWKNKELKCGSGIFITDNVHTWTEQYKFQPESPSKLASAIQKAHEEGICGIRSVTRLENLMWKQITPELNHILSENEVKLTIMTGDIRGIMQAGKRSLRPQPTELKYSWKTWGKAKMLSTESHNQTFLIDGPETAECPNTNRAWNSLEVEDYGFGVFTTNIWLKLRDKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDLCEGTTVVVTEDCGNRGPSLRTTTASGKLITEWCCRSCTLPPLRYRGEDGCWYGMEIRPLKEKEENLVNSLVTAGHGQIDNFSLGVLGMALLLEEMLRTRIGTKHAILLVAVSFVTLITGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLAVTVMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVEKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGIFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTTAIKTEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRKWCFDGIKNNQILEENMEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMEALQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDGRFWELVDRERNLHLEGKCETCVYNMMGKREKKLGEFGKAKGSRAIWYMWLGARFLEFEALGFLNEDHWFSRGNSLSGVEGEGLHRLGYILRDVGKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKSIQHLTAIEEIAVQNWLARVGRERLSRMAISGDDCVIKPIDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 3941 - protein, 3291 aa, Artificial Sequence
  derived and/or modified protein sequence (wt) from DENV-2__KF955366__SS-prME
TAGVIVMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVQPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEITDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAVVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRIGTKHAILLVAVSFVTLITGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVEKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGIFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIKTEHTGREIVDLMCHATFTMRLLSPVRVPNYNLIIMDEAHFTDPASIAARGYISTRVEMGEAAGIFMTATSPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRKWCFDGIKNNQILEENMEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTSTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMEALQRQYGGALVRNPLSRNSTHEMYWVSNATGNIVSSVNMISRMLINRFTMKHKKATYEPDVDLGSGTRNIGIESEIPNLDIIGKRIEKIKQEHEISWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTKKVRSNAALGAIFTDENKWKSAREAVEDGRFWELVDRERNLHLEGKCETCVYNMMGKREKKLGEFGKAKGSRAIWYMWLGARFLEFEALGFLNEDHWFSRGNSLSGVEGEGLHRLGYILRDVGKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKSIQHLTATEEIAVQNWLARVGRERLSRMAISGDDCVVKPIDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 3942 - protein, 3291 aa, Artificial Sequence
  derived and/or modified protein sequence (wt) from DENV-2__EU569700__SS-prME
TAGVIVMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVQPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEITDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAVVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRIGTKHAILLVAVSFVTLITGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVEKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGIFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIKTEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRKWCFDGIKNNQILEENMEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTSTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMEALQRQYGGALVRNPLSRNSTHEMYWVSNATGNIVSSVNMISRMLINRFTMKHKKATYEPDVDLGSGTRNIGIESEIPNLDIIGKRIEKIKQEHEISWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTKKVRSNAALGAIFTDENKWKSAREAVEDGRFWELVDRERNLHLEGKCETCVYNMMGKREKKLGEFGKAKGSRAIWYMWLGARFLEFEALGFLNEDHWFSRGNSLSGVEGEGLHRLGYILRDVGKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKSIQHLTATEEIAVQNWLARVGRERLSRMAISGDDCVVKPIDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 3943 - protein, 3291 aa, Artificial Sequence
  derived and/or modified protein sequence (wt) from DENV-2__KF955369__SS-prME
TAGVIVMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTTVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVQPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEITDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAVVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRIGTKHAILLVAVSFVTLITGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVEKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGIFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIKTEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRKWCFDGIKNNQILEENMEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTSTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMEALQRQYGGALVRNPLSRNSTHEMYWVSNATGNIVSSVNMISRMLINRFTMKHKKATYEPDVDLGSGTRNIGIESEIPNLDIIGKRIEKIKQEHEISWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTKKVRSNAALGAIFTDENKWKSAREAVEDGRFWELVDRERNLHLEGKCETCVYNMMGKREKKLGEFGKAKGSRAIWYMWLGARFLEFEALGFLNEDHWFSRGNSLSGVEGEGLHRLGYILRDVGKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKSIQHLTATEEIAVQNWLARVGRERLSRMAISGDDCVVKPIDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 3944 - protein, 3291 aa, Artificial Sequence
  derived and/or modified protein sequence (wt) from DENV-2__EU569702__SS-prME
TAGVIVMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVQPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEITDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAVVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMERASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRIGTKHAILLVAVSFVTLITGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVEKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGIFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIKTEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDSEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRKWCFDGIKNNQILEENMEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTSTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMEALQRQYGGALVRNPLSRNSTHEMYWVSNATGNIVSSVNMISRMLINRFTMKHKKATYEPDVDLGSGTRNIGIESEIPNLDIIGKRIEKIKQEHEISWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTKKVRSNAALGAIFTDENKWKSAREAVEDGRFWELVDRERNLHLEGKCETCVYNMMGKREKKLGEFGKAKGSRAIWYMWLGARFLEFEALGFLNEDHWFSRGNSLSGVEGEGLHRLGYILRDVGKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKSIQHLTATEEIAVQNWLARVGRERLSRMAISGDDCVVKPIDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 3945 - protein, 3291 aa, Artificial Sequence
  derived and/or modified protein sequence (wt) from DENV-2__EU482624__SS-prME
TAGVIVMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILANTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVQPENLEYTIVITPHSGEEHAVGNDTGKHGKEIKITPQSSITEAELTGYGTVTMECSPRTGLDFNEMVLLQMEDKAWLVHRQWFLDLPLPWLPGADIQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEITDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAVVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRIGTKHAILLVAVSFVTLITGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVEKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGIFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIKTEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRKWCFDGIKNNQILEENMEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTSTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMEALQRQYGGALVRNPLSRNSTHEMYWVSNATGNIVSSVNMISRMLINRFTMKHKKATYEPDVDLGSGTRNIGIESEIPNLDIIGKRIEKIKQEHEISWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTKKVRSNAALGAIFTDENKWKSAREAVEDGRFWELVDRERNLHLEGKCETCVYNMMGKREKKLGEFGKAKGSRAIWYMWLGARFLEFEALGFLNEDHWFSRGNSLSGVEGEGLHRLGYILRDVGKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKSIQHLTATEEIAVQNWLARVGRERLSRMAISGDDCVVKPIDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 3946 - protein, 3291 aa, Artificial Sequence
  derived and/or modified protein sequence (wt) from DENV-2__EU596500__SS-prME
TAGVIVMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVQPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEITDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAVVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMVIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRIGTKHAILLVAVSFVTLITGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVEKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGIFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIKTEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRKWCFDGIKNNQILEENMEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKSIGKMTLGMCCIITASILLWHAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGKGWPLSKMDIGVPLFAIGCYYQVNPITLTAALLLLVAHNAIIGQGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTSTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMEALQRQYGGALVRNPLSRNSTHEMYWVSNATGNIVSSVNMISRMLINRFTMKHKKATYEPDVDLGSGTRNIGIENEIPNLDIIGKRIEKIKQEHEISWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDGRFWELVDRERNLHLEGKCETCVYNMMGKREKKLGEFGKAKGSRAIWYMWLGARFLEFEALGFLNEDHWFSRGNSLSGVEGEGLHRLGYILRDVGKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKSIQHLTATEEIAVQNWLARVGRERLSRMAISGDDCVVKPIDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 3947 - protein, 3291 aa, Artificial Sequence
  derived and/or modified protein sequence (wt) from DENV-2__EU482626__SS-prME
TAGVIVMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVQPENLEYTIVITPHSGEEHAVGNDTGKHGKEIKITPQSSITEAELTGYGTVTMECSPRTGLDFNEMVLLQMEDKAWLVHRQWFLDLPLPWLPGADIQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEITDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAVVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTQLKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRIGTKHAILLVAVSFVTLITGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVEKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGIFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIKTEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRKWCFDGIKNNQILEENMEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTSTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMEALQRQYGGALVRNPLSRNSTHEMYWVSNATGNIVSSVNMISRMLINRFTMKHKKATYEPDVDLGSGTRNIGIESEIPNLDIIGKRIEKIKQEHEISWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTKKVRSNAALGAIFTDENKWKSAREAVEDGRFWELVDRERNLHLEGKCETCVYNMMGKREKKLGEFGKAKGSRAIWYMWLGARFLEFEALGFLNEDHWFSRGNSLSGVEGEGLHRLGYILRDVGKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKSIQHLTATEEIAVQNWLARVGRERLSRMAISGDDCVVKPIDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 3948 - protein, 3291 aa, Artificial Sequence
  derived and/or modified protein sequence (wt) from DENV-2__EU482629__SS-prME
TAGVIVMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKIVQPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEITDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAMVQADSGCVVSWKNKELKCGSGIFITDNVHTWTEQYKFQPESPSKLASAIQKAHEEGICGIRSVTRLENLMWKQITPELNHILSENEVKLTIMTGDIRGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDLCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRIGTKHAILLVAVSFVTLITGNMSFKDLGRVMVMMGATMTDDIGMGVTYLALLAAFKVRPTFAAGLLLRKLTSKELMMATIGIALLSQSTIPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVEKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGIFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTTAIKTEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRKWCFDGIKNNQILEENMEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFITPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMEALQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDGRFWELVDRERNLHLEGKCETCVYNMMGKREKKLGEFGKAKGSRAIWYMWLGARFLEFEALGFLNEDHWFSRGNSLSGVEGEGLHRLGYILRDVGKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKSIQHLTATEEIAVQNWLARVGRERLSRMAISGDDCVVKPIDDRFASALTALNDMGKIRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 3949 - protein, 3291 aa, Artificial Sequence
  derived and/or modified protein sequence (wt) from DENV-2__FJ390390__SS-prME
TAGVIVMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAKFTCKKNMEGKVVQPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEITDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAMVQADSGCVVSWKNKELKCGSGIFITDNVHTWTEQYKFQPESPSKLASAIQKAHEEGICGIRSVTRLENLMWKQITPELNHILSENEVKLTIMTGDIRGIMQAGKRSLRPQPTELKYSWKTWGKAKMLSTESHNQTFLIDGPETAECPNTNRAWNSLEVEDYGFGVFTTNIWLKLRDKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDLCEGTTVVVTEDCGNRGPSLRTTTASGKLITEWCCRSCTLPPLRYRGEDGCWYGMEIRPLKEKEENLVNSLVTAGHGQIDNFSLGVLGMALLLEEMLRTRIGTKHAILLVAVSFVTLITGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLAVTVMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVEKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGIFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTTAIKTEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRKWCFDGIKNNQILEENMEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMEALQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDGRFWELVDRERNLHLEGKCETCVYNMMGKREKKLGEFGKAKGSRAIWYMWLGARFLEFEALGFLNEDHWFSRGNSLSGVEGEGLHRLGYILRDVGKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKSIQHLTATEEIAVQNWLARVGRERLSRMAISGDDCVVKPIDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 3950 - protein, 3291 aa, Artificial Sequence
  derived and/or modified protein sequence (wt) from DENV-2__FJ390391__SS-prME
TAGVIVMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVQPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEITDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAVVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRIGTKHAILLVAVSFVTLITGNMSFRDLGRVMVMVGATMTDDIGMGVTYLALLAAFKVRPTFAAGLLLRKLTSKELMMATIGIALLSQSTIPETIFELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVEKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGIFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIKTEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRKWCFDGIKNNQILEENMEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTSTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMEALQRQYGGALVRNPLSRNSTHEMYWVSNATGNIVSSVNMISRMLINRFTMKHKKATYEPDVDLGSGTRNIGIENEIPNLDIIGKRIEKIKQEHEISWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTKKVRSNAALGAIFTDENKWKSAREAVEDGRFWELVDRERNLHLEGKCETCVYNMMGKREKKLGEFGKAKGSRAIWYMWLGARFLEFEALGFLNEDHWFSRGNSLSGVEGEGLHRLGYILRDVGKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKSIQHLTATEEIAVQNWLARVGRERLSRMAISGDDCVVKPIDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 3951 - protein, 3291 aa, Artificial Sequence
  derived and/or modified protein sequence (wt) from DENV-2__FJ882593__SS-prME
TAGVIVMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVQPENLEYTIVITPHSGEEHAVGNDTGKHGKEIKITPQSSITEAELTGYGTVTMECSPRTGLDFNEMVLLQMEDKAWLVHRQWFLDLPLPWLPGADTQESNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEITDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAVVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRIGTKHAILLVAVSFVTLITGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVEKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGIFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIKTEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRKWCFDGIKNNQILEENMEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTSTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMEALQRQYGGALVRNPLSRNSTHEMYWVSNATGNIVSSVNMISRMLINRFTMKHKKATYEPDVDLGSGTRNIGIESEIPNLDIIGKRIEKIKQEHEISWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTKKVRSNAALGAIFTDENKWKSAREAVEDGRFWELVDRERNLHLEGKCETCVYNMMGKREKKLGEFGKAKGSRAIWYMWLGARFLEFEALGFLNEDHWFSRGNSLSGVEGEGLHRLGYILRDVGKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKSIQHLTATEEIAVQNWLARVGRERLSRMAISGDDCVVKPIDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 3952 - protein, 3291 aa, Artificial Sequence
  derived and/or modified protein sequence (wt) from DENV-2__FJ182014__SS-prME
TAGVIVMLIPTAMAFHLTTRNGEPHMIVGRQEKGKSLLFKTEDGVNMCTLMAIDLGELCEDTITYKCPFLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVQPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEITDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAVVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRIGTKHAILLVAVSFVTLITGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSIIISEDGSMSIKNEEEEQTLTILIRTGLLVISGVFPVSIPITAAAWYLWEVKKQRAGVLWDVPSPPPVEKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGIFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIKTEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRKWCFDGIKNNQILEENMEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTSTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMEALQRQYGGALVRNPLSRNSTHEMYWVSNATGNIVSSVNMISRMLINRFTMKHKKATYEPDVDLGSGTRNIGIESEIPNLDIIGKRIEKIKQEHEISWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTKKVRSNAALGAIFTDENKWKSAREAVEDGRFWELVDRERNLHLEGKCETCVYNMMGKREKKLGEFGKAKGSRAIWYMWLGARFLEFEALGFLNEDHWFSRGNSLSGVEGEGLHRLGYILRDVGKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKSIQHLTATEEIAVQNWLARVGRERLSRMAISGDDCVVKPIDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 3953 - protein, 3291 aa, Artificial Sequence
  derived and/or modified protein sequence (wt) from DENV-2__FJ547090__SS-prME
TAGVIVMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVQPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEITDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAVVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLREKQDVFCDSKLMSATIKDNRAVHADMGYWIESALNDTWKMEKASFIEVKSCHWPKSHTLWSNGVLESEMIIPKNFAGPVSQHNYRLGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRIGTKHAILLVAVSFVTLITGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVEKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGIFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIKTEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRKWCFDGIKNNQILEENMEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTSTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMEALQRQYGGALVRNPLSRNSTHEMYWVSNATGNIVSSVNMISRMLINRFTMKHKKATYEPDVDLGSGTRNIGIESEIPNLDIIGKRIEKIKQEHEISWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTKKVRSNAALGAIFTDENKWKSAREAVEDGRFWELVDRERNLHLEGKCETCVYNMMGKREKKLGEFGKAKGSRAIWYMWLGARFLEFEALGFLNEDHWFSRGNSLSGVEGEGLHRLGYILRDVGKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKSIQHLTATEEIAVQNWLARVGRERLSRMAISGDDCVVKPIDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 3954 - protein, 3291 aa, Artificial Sequence
  derived and/or modified protein sequence (wt) from DENV-2__EU482630__SS-prME
TAGVIVMLIPTAMAFHLTTRNGEPHMIVGRQEKGKSLLFKTEDGVNMCTLMAIDLGELCEDTITYKCPFLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVQPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEITDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAVVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRIGTKHAILLVAVSFVTLITGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVEKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGIFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIKTEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRKWCFDGIKNNQILEENMEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTSTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMEALQRQYGGALVRNPLSRNSTHEMYWVSNATGNIVSSVNMISRMLINRFTMKHKKATYEPDVDLGSGTRNIGIESEIPNLDIIGKRIEKIKQEHEISWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTKKVRSNAALGAIFTDENKWKSAREAVEDGRFWELVDRERNLHLEGKCETCVYNMMGKREKKLGEFGKAKGSRAIWYMWLGARFLEFEALGFLNEDHWFSRGNSLSGVEGEGLHRLGYILRDVGKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKSIQHLTATEEIAVQNWLARVGRERLSRMAISGDDCVVKPIDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 3955 - protein, 3291 aa, Artificial Sequence
  derived and/or modified protein sequence (wt) from DENV-2__FJ882594__SS-prME
TAGVIVMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVQPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEITDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAMVQADSGCVVSWKNKELKCGSGIFITDNVHTWTEQYKFQPESPSKLASAIQKAHEEGICGIRSVTRLENLMWKQITPELNHILSENEVKLTIMTGDIRGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDLCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRIGTKHAILLVAVSFVTLITGNMSFRDLGRVMVMVGATMTDDIGMGVTYLALLAAFKVRPTFAAGLLLRKLTSKELMMATIGIALLSQSTIPENILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVEKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGIFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTTAIKTEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRKWCFDGIKNNQILEENMEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMEALQRKYGGALVRNPLSRNSTHEMYWVSNATGNIVSSVNMISRMLINRFTMKHKKATYEPDVDLGSGTRNIGIESEIPNLDIIGKRIEKIKQEHEASWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTKKVRSNAALGAIFTDENKWKSAREAVEDGRFWELVDRERNLHLEGKCETCVYNMMGKREKKLGEFGRAKGSRAIWYMWLGARFLEFEALGFLNEDHWFSRGNSLSGVEGEGLHRLGYILRDVGKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKSIQHLTATEEIAVQNWLARVGRERLSRMAISGDDCVVKPIDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 3956 - protein, 3291 aa, Artificial Sequence
  derived and/or modified protein sequence (wt) from DENV-2__FJ205885__SS-prME
TAGVIVMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVQPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEITDLEKRHVLGRLITVNPIVTEKDSPVNIEAEPPFGDSYIIIGVEPGQLKLNWFKKGSSIGQMFETTMRGAKRMAILGDTAWDFGSLGGVLTSIGKALHQVFGAIYGAAFSGVSWTMKILIGVIITWIGMNSRSTSLSVSLVLVGVVTLYLGAVVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRIGTKHAILLVAVSFVTLITGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVEKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGIFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIKTEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYTDRKWCFDGIKNNQILEENMEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTSTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMEALQRQYGGALVRNPLSRNSTHEMYWVSNATGNIVSSVNMISRMLINRFTMKHKKATYEPDVDLGSGTRNIGIESEIPNLDIIGKRIEKIKQEHEISWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDGRFWELVDRERNLHLEGKCETCVYNMMGKREKKLGEFGKAKGSRAIWYMWLGARFLEFEALGFLNEDHWFSRGNSLSGVEGEGLHRLGYILRDVGKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKSIQHLTATEEIAVQNWLARVGRERLSRMAISGDDCVVKPIDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 3957 - protein, 3291 aa, Artificial Sequence
  derived and/or modified protein sequence (wt) from DENV-2__FJ744743__SS-prME
TAGVIVMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVQPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEITDLEKRHVLGRLITVNPIVTGKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAVVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLWPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRIGTKHAILLVAVSFVTLITGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVEKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGIFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIKTEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRKWCFDGIKNNQILEENMEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSVTTQESESNILDIDLRPASAWTLYAVATTFVTPMLRHSIENSSVNVSLTAIANQATVLMGLGKGWPLSKMDIGVPLLAIGCYSQVNPITLTATLLRFVAQYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTSTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMEALQRQYGGALVRNPLSRNSTHEMYWVSNATGNIVSSVNMISRMLINRFTMKHKKATYEPDVDLGSGTRNIGIESEIPNLDIIGKRIEKIKQEHEISWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTKKVRSNAALGAIFTDENKWKSAREAVEDGRFWELVDRERNLHLEGKCETCVYNMMGKREKKLGEFGKAKGSRAIWYMWLGARFLEFEALGFLNEDHWFSRGNSLSGVEGEGLHRLGYILRDVGKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKSIQHLTAIEEIAVQNWLARVGRERLSRMAISGDDCVVKPIDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 3958 - protein, 3291 aa, Artificial Sequence
  derived and/or modified protein sequence (wt) from DENV-2__JN819424__SS-prME
TAGVIVMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVQPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEITDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAVVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLREKQDVFCDSKLMSASSIDNRAVHADMGYWMESAPSDSCKMEKASFIEDKSCYWPNSQHLWSNGVLESEMIFPKNFAGPVSQHIYRPGYHTQTAGPCNLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRIGTKHAILLVAVSFVTLITGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVEKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGIFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIKTEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVEAIDGEYRLRGEARKTFVDLMRRGDLPVRLAYKVAAEGINYADRKWCFDGIKNSQILEENMEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTSTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMEALQRQYGGALVRNPLSRNSTHEMYWVSNATGNIVSSVNMISRMLINRFTMKHKKATYEPDVDLGSGTRNIGIESEIPNLDIIGKRIEKIKQEHEISWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTKKVRSNAALGAIFTDENKWKSAREAVEDGRFWELVDRERNLHLEGKCETCVYNMMGKREKKLGEFGKAKGSRAIWYMWLGARFLEFEALGFLNEDHWFSRGNSLSGVEGEGLHRLGYILRDVGKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKSIQHLTATEEIAVQNWLARVGRERLSRMAISGDDCVVKPIDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 3959 - protein, 3291 aa, Artificial Sequence
  derived and/or modified protein sequence (wt) from DENV-2__FJ744741__SS-prME
TAGVIVMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVQPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEITDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAMVQADSGCVVSWKNKELKCGSGIFITDNVHTWTEQYKFQPESPSKLASAIQKAHEEGICGIRSVTRLENLMWKQITPELNHILSENEVKLTIMTGDIRGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDLCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRIGTKHAILLVAVSFVTLITGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLAVTIMAISCVPNAVILQNAWRVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVEKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGIFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTTAIKTEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRKWCFDGIKNNQILEENMEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMEALQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDGRFWELVDRERNLHLEGKCETCVYNMMGKREKKLGEFGKAKGSRAIWYMWLGARFLEFEALGFLNEDHWFSRGNSLSGVEGEGLHRLGYILRDVGKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKSIQHLTATEEIAVQNWLARVGRERLSRMAISGDDCVVKPIDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 3960 - protein, 3291 aa, Artificial Sequence
  derived and/or modified protein sequence (wt) from DENV-2__FJ744703__SS-prME
TAGVIVMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVQPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRTDKLQLKGMSYSMCTGKFKIVKEIAETQHGTIVIRVQYEGDGSPCKIPFEITDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAVVQADSGCVVSWKNKELKCGSGIFITDNVHTWTEQYKFQPESPSKLASAIQKAHEEGICGIRSVTRLENLMWKQITPELNHIPSENEVKLTIMTGDIKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRIGTKHAILLVAVSFVTLITGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVEKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGIFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIKTEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRKWCFDGIKNNQILEENMEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTSTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMEALQRQYGGALVRNPLSRNSTHEMYWVSNATGNIVSSVNMISRMLINRFTMKHKKATYEPDVDLGSGTRNIGIESEIPNLDIIGKRIEKIKQEHEISWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTKKVRSNAALGAIFTDENKWKSAREAVEDGRFWELVDRERNLHLEGKCETCVYNMMGKREKKLGEFGRAKGSRAIWYMWLGARFLEFEALGFLNEDHWFSRGNSLSGVEGEGLHRLGYILRDVGKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKSIQHLTATEEIAVQNWLARVGRERLSRMAISGDDCVVKPIDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 3961 - protein, 3291 aa, Artificial Sequence
  derived and/or modified protein sequence (wt) from DENV-2__FJ850067__SS-prME
TAGVIVMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVQPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEITDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAMVQADSGCVVSWKNKELKCGSGIFITDNVHTWTEQYKFQPESPSKLASAIQKAHEEGICGIRSVTRLENLMWKQITPELNHILSENEVKLTIMTGDIRGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDLCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRIGTKHAILLVAVSFVTLITGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVEKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGIFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTTAIKTEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRKWCFDGIKNNQILEENMEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTLVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTNTRRGTGTIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCETLLCDIGESSPNPTIEAGRTLRVLNLVENWLNNNTQFCIKVLNPYMPSVIEKMEALQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDGRFWELVDRERNLHLEGKCETCVYNMMGKREKKLGEFGKAKGSRAIWYMWLGARFLEFEALGFLNEDHWFSRGNSLSGVEGEGLHRLGYILRDVGKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKSIQHLTATEEIAVQNWLARVGRERLSRMAISGDDCVVKPIDDRFASALTALNDMGKIRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 3962 - protein, 3291 aa, Artificial Sequence
  derived and/or modified protein sequence (wt) from DENV-2__FJ850060__SS-prME
TAGVIVMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVQPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEITDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDLCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRIGTKHAILLVAVSFVTLITGNMSFRDLGRVMVMVGATMTDDIGMGVTYLALLAAFKIRPTFAAGLLLRKLTSKELMMATIGIALLSQSTIPETILELTDALALGMMVLKIVRNMEKYQLAVTIMAISCVPNAVILQNAWKVSCAILAAVSVSPLLLTSSQQKADWIPLALTIKGLNPTAIFLTTLSRTSKKRSWPLNEAVMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVEKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGIFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIKTEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRKWCFDGIRNNQILEENMEVEIWTKEGERKKLKPRWLDARIYSDPLALKEFKEFAAGRKSLTLNLITEMGKLPTFMTQKARNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMEALQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDGRFWELVDRERNLHLEGKCETCVYNMMGKREKKLGEFGKAKGSRAIWYMWLGARFLEFEALGFLNEDHWFSRGNSLSGVEGEGLHRLGYILRDVGKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKSIQHLTATEEIAVQNWLARVGRERLSRMAISGDDCVVKPIDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPPHWVPTSRTTWSIHAKHEWMTTEDMLAVWNRVWIQGNPWMEDKTPVESWEEVPYLGKREDQWCGSLIGLTSRATWAKNIQTAINQVRSLIGNEEYTDYMPSMKRFRREEEEAGVLW

SEQ ID NO: 3963 - protein, 3291 aa, Artificial Sequence
  derived and/or modified protein sequence (wt) from DENV-2__FJ850061__SS-prME
TAGVIIMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVQPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEITDLEKRHVLGRLITVNPIVTEKDSPVNIEAEPPFGDSYIIIGVEPGQLKLNWFKKGSSIGQMFATTMRGAKRMAILGDTAWDFGSLGGVFTSIGKALHQVFGAIYGAAFSGVSWTMKILIGVIITWIGMNSRSTSLSVSLVLVGVVTLYLGAMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDLCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRIGTKHAILLVAVSFVTLITGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVEKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGIFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIKTEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRKWCFDGIKNNQILEENMEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGKGWPLSKMDIGVPLLAIGCYSQVKPITFTAALLLLVAHYAIIGPGLQAKAPREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMEALQRKYGGALVRNPLSRNSTHEMYWVSNATGNIVSSVNMISRMLINRFTMKHKKATYEPDVDLGSGTRNIGIESEVPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDGRFWELVDRERNLHLEGKCETCVYNMMGKREKKLGEFGKAKGSRAIWYMWLGARFLEFEALGFLNEDHWFSRGNSLSGVEGEGLHRLGYILRDVGKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKSIQHLTATEEIAVQNWLARVGRERLSRMAISGDDCVVKPIDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPPHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 3964 - protein, 3291 aa, Artificial Sequence
  derived and/or modified protein sequence (wt) from DENV-2__FJ744709__SS-prME
TAGVIVMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAVLAYTIGTTHFQKALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVQPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEITDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAVVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRIGTKHAILLVAVSFVTLITGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGIFPVSIPITAAAWYLWEVKKQRAGVLWDVPSPPPVEKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGIFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIKTEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYTDRKWCFDGIKNNQILEENMEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTSTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMEALQRQYGGALVRNPLSRNSTHEMYWVSNATGNIVSSVNMISRMLINRFTMKHKKATYEPDVDLGSGTRNIGIESEIPNLDIIGKRIEKIKQEHEISWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGRKKTPRMCTREEFTRKVRSNAALGAIFTDENKWKSAREAVEDGRFWELVDRERNLHLEGKCETCVYNMMGKREKKLGEFGKAKGSRAIWYMWLGARFLEFEALGFLNEDHWFSRENSLSGVEGEGLHRLGYILRDVGKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKSIQHLTATEEIAVQNWLARVGRERLSRMAISGDDCVVKPIDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 3965 - protein, 3291 aa, Artificial Sequence
  derived and/or modified protein sequence (wt) from DENV-2__FJ744708__SS-prME
TAGVIVMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVQPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEITDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAVVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRIGTKHAILLVAVSFVTLITGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVEKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGIFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIKTEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRKWCFDGIKNNQILEENMEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASILLWYAEIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMVNIFSGSYLAGAGLHVPLRKNTLRTRRGTGNTGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMEALQRQYGGALVRNPLSRNSTHEMYWVSNATGNIVSSVNMISRMLINRFTMKHKKATYEPDVDLGSGTRNIGIESEIPNLDIIGKRIEKIKQEHEISWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTKKVRSNAALGAIFTDENKWKSAREAVEDGRFWELVDRERNLHLEGKCETCVYNMMGKREKKLGEFGKAKGSRAIWYMWLGARFLEFEALGFLNEDHWFSRGNSLSGVEGEGLHRLGYILRDVGKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKSIQHLTATEEIAVQNWLARVGRERLSRMAISGDDCVVKPIDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 3966 - protein, 3291 aa, Artificial Sequence
  derived and/or modified protein sequence (wt) from DENV-2__FJ810418__SS-prME
TAGVIVMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVQPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEITDLEKRHVLGRLITVNPIVTEKDSPVNIEAEPPFGDSYIIIGVEPGQLKLNWFKKGSSIGQMFKTTMRGAKRMAILGDTAWDFGSLGGVFTSIGKALHQVFGAIYGAAFSGVSWTMKILIGVVITWIGMNSRSTSLSVSLVLVGVVTLYLGAVVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMVIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRIGTKHAILLVAVSFVTLITGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVEKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGIFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIKTEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRKWCFDGIKNNQILEENMEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTSTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMEALQRQYGGALVRNPLSRNSTHEMYWVSNATGNIVSSVNMISRMLINRFTMKHKKATYEPDVDLGSGTRNIGIESEIPNLDIIGKRIEKIKQEHEISWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTRVEFTKKVRSNAALGAIFTDENKWKSAREAVEDGRFWELVDRERNLHLEGKCETCVYNMMGKREKKLGEFGKAKGSRAIWYMWLGARFLEFEALGFLNEDHWFSRGNSLSGVEGEGLHRLGYILRDVGKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKSIQHLTATEEIAVQNWLARVGRERLSRMAISGDDCVVKPIDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 3967 - protein, 3291 aa, Artificial Sequence
  derived and/or modified protein sequence (wt) from DENV-2__FJ639835__SS-prME
TAGVIVMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVQPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEITDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAVVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMVIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRIGTKHAILLVAVSFVTLITGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVEKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGIFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIKTEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRKWCFDGIKNNQILEENMEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKSIGKMTLGMCCIITASILLWHAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTSTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMEALQRQYGGALVRNPLSRNSTHEMYWVSNATGNIVSSVNMISRMLINRFTMKHKKATYEPDVDLGSGTRNIGIENEIPNLDIIGKRIEKIKQEHEISWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDGRFWELVDRERNLHLEGKCETCVYNMMGKREKKLGEFGKAKGSRAIWYMWLGARFLEFEALGFLNEDHWFSRGNSLSGVEGEGLHRLGYILRDVGKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKSIQHLTATEEIAVQNWLARVGRERLSRMAISGDDCVVKPIDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 3968 - protein, 3291 aa, Artificial Sequence
  derived and/or modified protein sequence (wt) from DENV-2__FJ850050__SS-prME
TAGVIVMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVQPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGGTEIQMSSGNLLFTGHLKCRLRMDKLQLKGMSYSMCTGKFKIVKEIAETQHGTIVIRVQYEGDGSPCKIPFEITDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAVVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKYNRAVHADMGYWIESAPCDSWEMQKASFIEVISCHWPKSLTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRIGTKHAILLVAVSFVTLITGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVEKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGIFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIKTEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRKWCFDGIKNNQILEENMQEQIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTSTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMEALQRQYGGALVRNPLSRNSTHEMYWVSNATGNIVSSVNMISRMLINRFTMKHKKATYEPDVDLGSGTRNIGIESEIPNLDIIGKRIEKIKQEHEISWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTKKVRSNAALGAIFTDENKWKSAREAVEDGRFWELVDRERNLHLEGKCETCVYNMMGKREKKLGEFGKAKGSRAIWYMWLGARFLEFEALGFLNEDHWFSRGNSLSGVEGEGLHRLGYILRDVGKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKSIQHLTATEEIAVQNWLARVGRERLSRMAISGDDCVVKPIDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 3969 - protein, 3291 aa, Artificial Sequence
  derived and/or modified protein sequence (wt) from DENV-2__FJ639837__SS-prME
TAGVIVMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVQPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEITDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAVVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMVIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRIGTKHAILLVAVSFVTLITGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVEKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGIFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIKTEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRKWCFDGIKNNQILEENMEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKSIGKMTLGMCCIITASILLWHAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLAPIPYDPKFEKQLGQVMLLILCVTQVLMMRTTWALCEALTLATGPISTLWEGNPGRFWNTTIAVSMANIFRGSYLAGAGLLFSIMKNTTSTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMEALQRQYGGALVRNPLSRNSTHEMYWVSNATGNIVSSVNMISRMLINRFTMKHKKATYEPDVDLGSGTRNIGIENEIPNLDIIGKRIEKIKQEHEISWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDGRFWELVDRERNLHLEGKCETCVYNMMGKREKKLGEFGKAKGSRAIWYMWLGARFLEFEALGFLNEDHWFSRGNSLSGVEGEGLHRLGYILRDVAKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKSIQHLTATEEIAVQNWLARVGRERLSRMAISGDDCVVKPIDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 3970 - protein, 3291 aa, Artificial Sequence
  derived and/or modified protein sequence (wt) from DENV-2__FJ744706__SS-prME
TAGVIVMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVQPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEITDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAVVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTGSHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRIGTKHAILLVAVSFVTLITGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVEKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGIFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIKTEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRKWCFDGIKNNQILEENMEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTSTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMEALQRQYGGALVRNPLSRNSTHEMYWVSNATGNIVSSVNMISRMLINRFTMKHKKATYEPDVDLGSGTRNIGIESEIPNLDIIGKRIEKIKQEHEISWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTKKVRGNAALGAIFTDENKWKSAREAVEDGRFWELVDRERNLHLEGKCETCVYNMMGKREKKLGEFGKAKGSRAIWYMWLGARFLEFEALGFLNEDHWFSRGNSLSGVEGEGLHRLGYILRDVGKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKSIQHLTATEEIAVQNWLARVGRERLSRMAISGDDCVVKPIDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 3971 - protein, 3291 aa, Artificial Sequence
  derived and/or modified protein sequence (wt) from DENV-2__FJ744707__SS-prME
TAGVIVMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVQPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEITDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAVVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRIGTKHAILLVAVSFVTLITGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVEKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGIFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIKTEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRKWCFDGIKNNQILEENMEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTSTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMEALQRQYGGALVRNPLSRNSTHEMYWVSNATGNIVSSVNMISRMLINRFTMKHKKATYEPDVDLGSGTRNIGIESEIPNLDIIGKRIEKIKQEHEISWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTKKVRSNAALGAIFTDENKWKSAREAVEDGRFWELVDRERNLHLEGKCETCVYNMMGKREKKLGEFGKAKGSRAIWYMWLGARFLEFEALGFLNEDHWFSRGNSLSGVEGEGLHRLGYILRDVGKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKSIQHLTATEEIAVQNWLARVGRERLSRMAISGDDCVVKPIDDRFASALTALNDMGKVRKDIQQWEPSRGWNDWTQVPFCSHHFHELVMKDGRVLVAPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 3972 - protein, 3291 aa, Artificial Sequence
  derived and/or modified protein sequence (wt) from DENV-2__FJ744704__SS-prME
TAGVIVMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVQPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEITDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAMVQADSGCVVSWKNKELKCGSGIFITDNVHTWTEQYKFQPESPSKLASAIQKAHEEGICGIRSVTRLENLMWKQITPELNHILSENEVKLTIMTGDIRGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDLCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRIGTKHAILLVAVSFVTLITGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVEKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGMFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIKTEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRKWCFDGIKNNQILEENMEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMEALQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRICTREEFTRKVRSNAALGAIFTDENKWKSAREAVEDGRFWELVDRERNLHLEGKCETCVYNMMGKREKKLGEFGKAKGSRAIWYMWLGARFLEFEALGFLNEDHWFSRENSLSGVEGEGLHRLGYILRDVGKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKSIQHLTATEEIAVQNWLARVGRERLSRMAISGDDCVVKPIDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPPHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 3973 - protein, 3291 aa, Artificial Sequence
  derived and/or modified protein sequence (wt) from DENV-2__FJ744745__SS-prME
TAGVIVMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVQPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLKMDKLQLKGMSYSMCTGKFKIVKEIAETQHGTIVIRVQYEGDGSPCKIPFEITDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAMVQADSGCVVSWKNKELKCGSGIFITDNVHTWTEQYKFQPESPSKLASAIQKAHEEGICGIRSVTRLENLMWKQITPELNHILSENEVKLTIMTGDIRGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDLCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRIGTKHAILLVAVSFVTLITGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVEKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGIFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIKTEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRKWCFDGIKNNQILEENMEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASTLLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMEALQRKYGGALVRNPLSRNSTHEMYWVSNASGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDRERNLHLEGKCETCVYNMMGKREKKLGEFGKAKGSRAIWYMWLGARFLEFEALGFLNEDHWFSRGNSLSGVEGEGLHRLGYILRDVGKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKSIQHLTATEEIAVQNWLARVGRERLSRMAISGDDCVVKPIDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPPHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 3974 - protein, 3291 aa, Artificial Sequence
  derived and/or modified protein sequence (wt) from DENV-2__FJ744705__SS-prME
TAGVIVMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVQPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDDSPCKIPFEITDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAMVQADSGCIVSWKNKELKCGSGIFITDNVHTWTEQYKFQPESPSKLASAIQKAHEEGICGIRSVTRLENLMWKQITPELNHILSENEVKLTIMTGDIRGIMQAGKRSLRPQPTELKYSWKTWGKAKMLSTESHNQTFLIDGPETVECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDLCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRIGTKHAILLVAVSFVTLITGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVEKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGIFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIKTEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRKWCFDGIKNNQILEENMEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMEALQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDGRFWELVDRERNLHLEGKCETCVYNMMGKREKKLGEFGKAKGSRAIWYMWLGARFLEFEALGFLNEDHWFSRGNSLSGVEGEGLHRLGYILRDVGKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKSIQHLTATEEIAVQNWLARVGRERLSRMAISGDDCVVKPIDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPPHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 3975 - protein, 3291 aa, Artificial Sequence
  derived and/or modified protein sequence (wt) from DENV-2__FJ744744__SS-prME
TAGVIVMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVQPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLKMDKLQLKGMSYSMCTGKFKIVKEIAETQHGTIVIRVQYEGDGSPCKIPFEITDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAMVQADSGCVVSWKNKELKCGSGIFITDNVHTWTEQYKFQPESPSKLASAIQKAHEEGICGIRSVTRLENLMWKQITPELNHILSENEVKLTIMTGDIRGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDLCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRIGTKHAILLVAVSFVTLITGNMSFRDLGRVMVMVGATMTDDIGMGVTYLALLAAFKVRPTFAVGLLLRKLTSKELMMATIGIALLSQSTIPETILELTDALALGMMVLKIVRNMEKYQLAVTIMAISCVPNAVILQNAWKVSCTILAVVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVEKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGIFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIKTEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDENCAHWKEAKMLLDNINTPEGIIPSMFEPEREKVDAIDGEYRLRGEARKTFVDLMRRGDLPVWLAYKVAAEGINYADRKWCFDGIKNNQILEENMEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMEALQRKYGGALVRNPLSRNSTHEMYWVSNASGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDRERNLHLEGKCETCVYNMMGKREKKLGEFGKAKGSRAIWYMWLGARFLEFEALGFLNEDHWFSRGNSLSGVEGEGLHRLGYILRDVGKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKSIQHLTATEEIAVQNWLARVGRERLSRMAISGDDCVVKPIDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPPHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 3976 - protein, 3291 aa, Artificial Sequence
  derived and/or modified protein sequence (wt) from DENV-2__GQ868646__SS-prME
TAGVIVMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAKFTCKKNMEGKVVQPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEITDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAMVQADSGCVVSWKNKELKCGSGIFITDNVHTWTEQYKFQPESPSKLASAIQKAHEEGICGIRSVTRLENLMWKQITPELNHILSENEVKLTIMTGDIRGIMQAGKRSLRPQPTELKYSWKTWGKAKMLSTESHNQTFLIDGPETAECPNTNRAWNSLEVEDYGFGVFTTNIWLKLRDKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDLCEGTTVVVTEDCGNRGPSLRTTTASGKLITEWCCRSCTLPPLRYRGEDGCWYGMEIRPLKEKEENLVNSLVTAGHGQIDNFSLGVLGMALLLEEMLRTRIGTKHAILLVAVSFVTLITGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLAVTVMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVEKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGIFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTTAIKTEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRKWCFDGIKNNQILEENMEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMEALQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKEKTPRMCTREEFTRKVRSNAALGAIFTDENKWKSAREAVEDGRFWELVDRERNLHLEGKCETCVYNMMGKREKKLGEFGKAKGSRAIWYMWLGARFLEFEALGFLNEDHWFSRGNSLSGVEGEGLHRLGYILRDVGKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKSIQHLTATEEIAVQNWLARVGRERLSRMAISGDDCVVKPIDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 3977 - protein, 3291 aa, Artificial Sequence
  derived and/or modified protein sequence (wt) from DENV-2__FJ906961__SS-prME
TAGVIVMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVQPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEITDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAMVQADSGCVVSWKNKELKCGSGIFITDNVHTWTEQYKFQPESPSKLASAIQKAHEEGICGIRSVTRLENLMWKQITPELNHILSENEVKLTIMTGDIRGIMQAGKRSLRPQPTELKYSWKTWGKAKMLSTEPHNQTFLIDGPETAECPNTNRAWNSLEVEDYGFGVFTTNIWLKLREKQEVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDLCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRIGTKHAILLVAVSFVTLITGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVEKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGIFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTTAIKTEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRKWCFDGIKNNQILEENMEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMEALQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDGRFWELVDRERNLHLEGKCETCVYNMMGKREKKLGEFGKAKGSRAIWYMWLGARFLEFEALGFLNEDHWFSRGNSLSGVEGEGLHRLGYILRDVGKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKSIQHLTATEEIAVQNWLARVGRERLSRMAISGDDCVVKPIDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 3978 - protein, 3291 aa, Artificial Sequence
  derived and/or modified protein sequence (wt) from DENV-2__FJ906962__SS-prME
TAGVIVMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVQPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEITDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAMVQADSGCVVSWKNKELKCGSGIFITDNVHTWTEQYKFQPESPSKLASAIQKAHEEGICGIRSVTRLENLMWKQITPELNHILSENEIKLTIMTGDIRGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDLCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRIGTKHAILLVAVSFVTLITGNMSFRDLGRVMVMVGATMTDDIGMGVTYLALLAAFKVRPTFAAGLLLRKLTSKELMMATIGIALLSQSTIPENILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVEKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGIFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTTAIKTEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRKWCFDGIKNNQILEENMEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMEALQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDGRFWELVDRERNLHLEGKCETCVYNMMGKREKKLGEFGKAKGSRAIWYMWLGARFLEFEALGFLNEDHWFSRGNSLSGVEGEGLHRLGYILRDVGKKEGGAMYADDTAGWDTRITLEDLKNEEMVTNHMKGEHKKLAEAIFKLTYQNKVVRVQRPTPRGTVMDIISRRDQRGSGQVGTYGLNTFTNIEAQLIRQMEGEGIFKSIQHLTATEEIAVQNWLARVGRERLSRMAISGDDCVVKPIDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 3979 - protein, 3291 aa, Artificial Sequence
  derived and/or modified protein sequence (wt) from DENV-2__FJ850053__SS-prME
TAGVIVMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVQPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEITDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAMVQADSGCVVSWKNKELKCGSGIFITDNVHTWTEQYKFQPESPSKLASAIQKAHEEGICGIRSVTRLENLMWKQITPELNHILSENEVKLTIMTGDIRGIMQAGKRSLRPQPTELKYSWKTWGKAKMLSTEPHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDLCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRIGTKHAILLVAVSFVTLITGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVEKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGIFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTTAIKTEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRKWCFDGIKNNQILEENMEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMEALQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDGRFWELVDRERNLHLEGKCETCVYNMMGKREKKLGEFGKAKGSRAIWYMWLGARFLEFEALGFLNEDHWFSRGNSLSGVEGEGLHRLGYILRDVGKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKSIQHLTATEEIAVQNWLARVGRERLSRMAISGDDCVVKPIDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 3980 - protein, 3291 aa, Artificial Sequence
  derived and/or modified protein sequence (wt) from DENV-2__JN819420__SS-prME
TAGVIVMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVQPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEITDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAVVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMERASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRIGTKHAILLVAVSFVTLITGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVEKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGIFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIKTEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDSEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRKWCFDGIKNNQILEENMEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGKGWPLSKMDIGVPLLAMGCYSQFKPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTSTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMEALQRQYGGALVRNPLSRNSTHEMYWVSNATGNIVSSVNMISRMLINRFTMKHKKATYEPDVDLGSGTRNIGIESEIPNLDIIGKRIEKIKQEHEISWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTKKVRSNAALGAIFTDENKWKSAREAVEDGRFWELVDRERNLHLEGKCETCVYNMMGKREKKLGEFGKAKGSRAIWYMWLGARFLEFEALGFLNEDHWFSRGNSLSGVEGEGLHRLGYILRDVGKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKSIQHLTATEEIAVQNWLARVGRERLSRMAISGDDCVVKPIDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 3981 - protein, 3291 aa, Artificial Sequence
  derived and/or modified protein sequence (wt) from DENV-2__FJ850118__SS-prME
TAGVIVMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVQPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEITDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAMVQADSGCVVSWKNKELKCGSGIFITDNVHTWTEQYKFQPESPSKLASAIQKAHEEGICGIRSVTRLENLMWKQITPELNHILSENEVKLTIMTGDIRGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDLCEGTTVVVTEDCGNRGPSLRTTTASGKLITEWCCRSCTLPPLRYRGEDGCWYGMEIRPLKEKEENLVNSLVTAGYGQIDNFSLGVLGMALFLEEMLRTRIGTKHAILLVAVSFVTLITGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVEKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGIFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIKTEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRKWCFDGIKNNQILEENMEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMEALQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDGRFWELVDRERNLHLEGKCETCVYNMMGKREKKLGEFGKAKGSRAIWYMWLGARFLEFEALGFLNEDHWFSRGNSLSGVEGEGLHRLGYILRDVGKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKSIQHLTATEEIAVQNWLARVGRERLSRMAISGDDCVVKPIDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPPHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 3982 - protein, 3291 aa, Artificial Sequence
  derived and/or modified protein sequence (wt) from DENV-2__JN819416__SS-prME
TAGVIVMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVQPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEITDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDLCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRIGTKHAILLVAVSFVTLITGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVEKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGIFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIKTEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRKWCFDGIKNNQILEENMEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMEALQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDRERNLHLEGKCETCVYNMMGKREKKLGEFGKAKGSRAIWYMWLGARFLEFEALGFLNEDHWFSRGNSLSGVEGEGLHRLGYILRDVGKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKSIQHLTATEEIAVQNWLARVGRERLSRMAISGDDCVVKPIDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPPHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 3983 - protein, 3291 aa, Artificial Sequence
  derived and/or modified protein sequence (wt) from DENV-2__FJ850119__SS-prME
TAGVIVMLIPTAMAFHLTTRNGEPHMIVGRQEKGKSLLFKTEDGINMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVQPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEITDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDLCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRIGTKHAILLVAVSFVTLITGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVEKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGIFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIKTEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRKWCFDGIKNNQILEENMEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMEALQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDGRFWELVDRERNLHLEGKCETCVYNMMGKREKKLGEFGKAKGSRAIWYMWLGARFLEFEALGFLNEDHWFSRGNSLSGVEGEGLHRLGYILRDVGKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKSIQHLTASEETAVQNWLARVGRERLSRMAISGDDCVVKPIDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPPHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 3984 - protein, 3291 aa, Artificial Sequence
  derived and/or modified protein sequence (wt) from DENV-2__FJ850064__SS-prME
TAGVIVMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVQPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEITDLEKRHVLGRLITVNPIVTEKDSPVNIEAEPPFGDSYIIIGVEPGQLKLNWFKKGSSIGQMFATTMRGAKRMAILGDTAWDFGSLGGVFTSIGKALHQVFGAIYGAAFSGVSWTMKILIGVIITWIGMNSRSTSLSVSLVLVGVVTLYLGAMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDLCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRIGTKHAILLVAVSFVTLITGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVEKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGIFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIKTEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRKWCFDGIKNNQILEENMEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMEALQRKYGGALVRNPLSRNSTHEMYWVSNATGNIVSSVNMISRMLINRFTMKHKKATYEPDVDLGSGTRNIGIESEVPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDGRFWELVDRERNLHLEGKCETCVYNMMGKREKKLGEFGKAKGSRAIWYMWLGARFLEFEALGFLNEDHWFSRGNSLSGVEGEGLHRLGYILRDVGKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKSIQHLTATEEIAVQNWLARVGRERLSRMAISGDDCVVKPIDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPPHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 3985 - protein, 3291 aa, Artificial Sequence
  derived and/or modified protein sequence (wt) from DENV-2__FJ850065__SS-prME
TAGVIVMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCTEAKLTNTTTESRCPTQGEPSLNEEQDKRFICKHSMVDRGWGNGCGLFGKGGIVTCAMFTCKKNMEGKVVQPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEITDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDLCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRIGTKHAILLVAVSFVTLITGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVEKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGIFKTNTGTIGAVSLDFSPGTSGSPIVDRKGKVVGLYGNGVVTRSGAYVSAIAQTEKSIEDNPEIEEDIFRKKRLTIMDLHPGAGKTKRYLPAIVREAIKRGLRTLILAPTRVVAAEMEEALRGLPIRYQTPAIKTEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRKWCFDGIKNNQILEENMEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMEALQRKHGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDGRFWELVDRERNLHLEGKCETCVYNMMGKREKKLGEFGKAKGSRAIWYMWLGARFLEFEALGFLNEDHWFSRGNSLSGVEGEGLHRLGYILRDVGKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKSIQHLTATEEIAVQNWLARVGRERLSRMAISGDDCVVKPIDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPPHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 3986 - protein, 3291 aa, Artificial Sequence
  derived and/or modified protein sequence (wt) from DENV-2__FJ873808__SS-prME
TAGVIVMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVQPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEITDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDLCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRIGTKHAILLVAVSFVTLITGNMSFRDLGRVMVMVGATMTDDIGMGVTYLALLAAFKIRPTFAAGLLLRKLTSKELMMATIGIALLSQSTIPETILELTDALALGMMVLKIVRNMEKYQLAVTIMAISCVPNAVILQNAWKVSCAILAAVSVSPLLLTSSKQKADWIPLALTIKGLNPTAIFLTTLSRTSKKRSWPLNEAVMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVEKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGIFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIKTEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRKWCFDGIRNNQILEENMEVEIWTKEGERKKLKPRWLDARIYSDPLALKEFKEFAAGRKSLTLNLITEMGKLPTFMTQKARNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMEALQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDGRFWELVDRERNLHLEGKCETCVYNMMGKREKKLGEFGKAKGSRAIWYMWLGARFLEFEALGFLNEDHWFSRGNSLSGVEGEGLHRLGYILRDVGKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKSIQHLTATEEIAVQNWLARVGRERLSRMAISGDDCVVKPIDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPPHWVPTSRTTWSIHAKHEWMTTEDMLAVWNRVWIQGNPWMEDKTPVESWEEVPYLGKREDQWCGSLIGLTSRATWAKNIQTAINQVRSLIGNEEYTDYMPSMKRFRREEEEAGVLW

SEQ ID NO: 3987 - protein, 3291 aa, Artificial Sequence
  derived and/or modified protein sequence (wt) from DENV-2__FJ850120__SS-prME
TAGVIVMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVQPENLEYTIVITPHSGEEHAVGNDTGKHGKEIKITPQSSVTEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEITDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAMVQADSGCVVSWKNKELKCGSGIFITDNVHTWTEQYKFQPESPSKLASAIQKAHEEGICGIRSVTRLENLMWKQITPELNHILSENEVKLTIMTGDIRGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDLCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRIGTKHAILLVAVSFVTLITGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVEKAKLEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGIFKTNTGTIGAVSLDFSPGTSGSPIVDRKGKVVGLYGNGVVTRSGAYVSAIAQTEKNIEDNPEIEDDIFRKKRLTIMDLHPGAGKTKRYLPAIVREAIKRGLRTLILAPTRVVAAEMEEALRGLPIRYQTPAIKTEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRKWCFDGIKNNQILEENMEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTNTRRGTGSIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMEALQRKYGGALVRNPLSRNSTHEMYWVSNATGNIVSSVNMISRMLINRFTMKHKKATYEPDVDLGSGTRNIGIENEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDRERNLHLEGKCETCVYNMMGKREKKLGEFGKAKGSRAIWYMWLGARFLEFEALGFLNEDHWFSRGNSLSGVEGEGLHRLGYILRDVGKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKSIQHLTATEEIAVQNWLARVGRERLSRMAISGDDCVVKPIDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 3988 - protein, 3291 aa, Artificial Sequence
  derived and/or modified protein sequence (wt) from DENV-2__FJ850121__SS-prME
TAGVIVMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKIVQPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEITDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDLCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRIGTKHVTLLVAVSFVTLITGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVEKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGIFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIKTEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRKWCFDGIKNNQILEENMEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMEALQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDGRFWELVDRERNLHLEGKCETCVYNMMGKREKKLGEFGKAKGSRAIWYMWLGARFLEFEALGFLNEDHWFSRGNSLSGVEGEGLHRLGYILRDVGKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKSIQHLTATEEIAVQNWLARVGRERLSRMAISGDDCVVKPIDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPPHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 3989 - protein, 3291 aa, Artificial Sequence
  derived and/or modified protein sequence (wt) from DENV-2__GQ199897__SS-prME
TAGVIVMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVQPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEITDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDLCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRIGTKHAILLVAVSFVTLITGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVVSGVFPVSIPITAAAWYLWEVKKQRAGVLWDVPSPPPVEKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGIFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIKTEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRKWCFDGIKNNQILEENMEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMEALQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDGRFWELVDRERNLHLEGKCETCVYNMMGKREKKLGEFGKAKGSRAIWYMWLGARFLEFEALGFLNEDHWFSRGNSLSGVEGEGLHRLGYILRDVGKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKSIQHLTATEEIAVQNWLARVGRERLSRMAISGDDCVVKPIDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPPHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 3990 - protein, 3291 aa, Artificial Sequence
  derived and/or modified protein sequence (wt) from DENV-2__GQ199895__SS-prME
TAGVIVMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVQPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEITDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDLCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRIGTKHAILLVAVSFVTLITGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVEKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGIFKTNTGTIGAVSLDFSPGTSGSPIVDRKGKVVGLYGNGVVTRSGAYVSAIAQTEKSIEDNPEIEEDIFRKKRLTIMDLHPGAGKTKRYLPAIVREAIKRGLRTLILAPTRVVAAEMEEALRGLPIRYQTPAIKTEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRKWCFDGIKNNQILEENMEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMEALQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDGRFWELVDRERNLHLEGKCETCVYNMMGKREKKLGEFGKAKGSRAIWYMWLGARFLEFEALGFLNEDHWFSRGNSLSGVEGEGLHRLGYILRDVGKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKSIQHLTATEEIAVQNWLARVGRERLSRMAISGDDCVVKPIDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPPHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 3991 - protein, 3291 aa, Artificial Sequence
  derived and/or modified protein sequence (wt) from DENV-2__FJ898478__SS-prME
TAGVIVMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVQPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEITDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDLCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRIGTKHAILLVAVSFVTLITGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVEKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGIFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIKTEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRKWCFDGIKNNQILEENMEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTSTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMEALQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDGRFWELVDRERNLHLEGKCETCVYNMMGKREKKLGEFGKAKGSRAIWYMWLGARFLEFEALGFLNEDHWFSRGNSLSGVEGEGLHRLGYILRDVGKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKSIQHLTATEEIAVQNWLARVGRERLSRMAISGDDCVVKPIDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 3992 - protein, 3291 aa, Artificial Sequence
  derived and/or modified protein sequence (wt) from DENV-2__GQ199869__SS-prME
TAGVIVMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVQPENLEYTIVITPHSGEEHAVGNDTGKHGKEIKITPQSSITEAELTGYGTVTMECSPRTGLDFNEMVLLQMEDKAWLVHRQWFLDLPLPWLPGADIQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEITDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAVVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRIGTKHAILLVAVSFVTLITGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVEKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGIFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIKTEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRKWCFDGIKNNQILEENMEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTSTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMEALQRQYGGALVRNPLSRNSTHEMYWVSNATGNIVSSVNMISRMLINRFTMKHKKATYEPDVDLGSGTRNIGIESEIPNLDIIGKRIEKIKQEHEISWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTKKVRSNAALGAIFTDENKWKSAREAVEDGRFWELVDRERNLHLEGKCETCVYNMMGKREKKLGEFGKAKGSRAIWYMWLGARFLEFEALGFLNEDHWFSRGNSLSGVEGEGLHRLGYILRDVGKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKSIQHLTATEEIAVQNWLARVGRERLSRMAISGDDCVVKPIDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 3993 - protein, 3291 aa, Artificial Sequence
  derived and/or modified protein sequence (wt) from DENV-2__JX079688__SS-prME
TAGVIVMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVQPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEITDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAVVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRIGTKHAILLVAVSFVTLITGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVEKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGIFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIKTEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRKWCFDGIKNNQILEENMEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASILLWHAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTSTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMEALQRQYGGALVRNPLSRNSTHEMYWVSNATGNIVSSVNMISRMLINRFTMKHKKATYEPDVDLGSGTRNIGIESEIPNLDIIGKRIEKIKQEHEISWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTKKVRSNAALGAIFTDENKWKSAREAVEDGRFWELVDRERNLHLEGKCETCVYNMMGKREKKLGEFGKAKGSRAIWYMWLGARFLEFEALGFLNEDHWFSRGNSLSGVEGEGLHRLGYILRDVGKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKSIQHLTATEEIAVQNWLARVGRERLSRMAISGDDCVVKPIDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGIEEYTDYMPSMKRFRREEEEAGVLW

SEQ ID NO: 3994 - protein, 3291 aa, Artificial Sequence
  derived and/or modified protein sequence (wt) from DENV-2__JF357906__SS-prME
TAGVIVMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAVLAYTIGTTHFQKALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVQPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEITDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAVVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRIGTKHAILLVAVSFVTLITGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGIFPVSIPITAAAWYLWEVKKQRAGVLWDVPSPPPVEKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGIFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIKTEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYTDRKWCFDGIKNNQILEENMEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTSTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMEALQRQYGGALVRNPLSRNSTHEMYWVSNATGNIVSSVNMISRMLINRFTMKHKKATYEPDVDLGSGTRNIGIESEIPNLDIIGKRIEKIKQEHEISWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGRKKTPRMCTREEFTRKVRSNAALGAIFTDENKWKSAREAVEDGRFWELVDRERNLHLEGKCETCVYNMMGKREKKLGEFGKAKGSRAIWYMWLGARFLEFEALGFLNEDHWFSRENSLSGVEGEGLHRLGYILRDVGKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKSIQHLTATEEIAVQNWLARVGRERLSRMAISGDDCVVKPIDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWYIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 3995 - protein, 3290 aa, Artificial Sequence
  derived and/or modified protein sequence (wt) from DENV-2__HQ705624__SS-prME
TAGVIVMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAKFTCKKNMEGKVVQPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKVPFEITDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAMVQADSGCVVSWKNKELKCGSGIFITDNVHTWTEQYKFQPESPSKLASAIKKAHEEGICGIRSVTRLENLMWKQITPELNHILSENEVKLTIMTGDIRGIMQAGKRSLRPQPTELKYSWKTWGKAKMLSTESHNQTFLIDGPETAECPNTNRAWNSLEVEDYGFGVFTTNIWLKLRDKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDLCEGTTVVVTEDCGNRGPSLRTTTASGKLITEWCCRSCTLPPLRYRGEDGCWYGMEIRPLKEKEENLVNSLVTAGHGQIDNFSLGVLGMALLLEEMLRTRIGTKHAILLVAVSFVTLITGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLAVTVMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVEKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGIFKTNTGTIGAVSLDFPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTTAIKTEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRKWCFDGIKNNQILEENMEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMEALQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDGRFWELVDRERNLHLEGKCETCVYNMMGKREKKLGEFGKAKGSRAIWYMWLGARFLEFEALGFLNEDHWFSRGNSLSGVEGEGLHRLGYILRDVGKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKSIQHLTATEEIAVQNWLARVGRERLSRMAISGDDCVVKPIDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 3996 - protein, 3291 aa, Artificial Sequence
  derived and/or modified protein sequence (wt) from DENV-2__HQ705625__SS-prME
TAGVIVMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELMKTEAKQPATLRKYCIEAKLTNTTTESRCPTQGEPSLNEEQDKRFICKHSMVDRGWGNGCGLFGKGGIVTCAMFTCKKNMEGKVVQPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEITDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAVVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRIGTKHAILLVAVSFVTLITGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVEKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGIFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIKTEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRKWCFDGTKNNQILEENMEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTSTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMEALQRQYGGALVRNPLSRNSTHEMYWVSNATGNIVSSVNMISRMLINRFTMKHKKATYEPDVDLGSGTRNIGIESEIPNLDIIGKRIEKIKQEHEISWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTKKVRSNAALGAIFTDENKWKSAREAVEDGRFWELVDRERNLHLEGKCETCVYNMMGKREKKLGEFGKAKGSRAIWYMWLGARFLEFEALGFLNEDHWFSRGNSLSGVEGEGLHRLGYILRDVGKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKSIQHLTATEEIAVQNWLARVGRERLSRMAISGDDCVVKPIDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 3997 - protein, 3291 aa, Artificial Sequence
  derived and/or modified protein sequence (wt) from DENV-2__JF730052__SS-prME
TAGVIVMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELMKTEAKQPATLRKYCIEAKLTNTTTESRCPTQGEPSLNEEQDKRFICKHSMVDRGWGNGCGLFGKGGIVTCAMFTCKKNMEGKVVQPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEITDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAVVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRIGTKHAILLVAVSFVTLTTGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVEKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGIFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIKTEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRKWCFDGTKNNQILEENMEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTSTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMEALQRQYGGALVRNPLSRNSTHEMYWVSNATGNIVSSVNMISRMLINRFTMKHKKATYEPDVDLGSGTRNIGIESEIPNLDIIGKRIEKIKQEHEISWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTKKVRSNAALGAIFTDENKWKSAREAVEDGRFWELVDRERNLHLEGKCETCVYNMMGKREKKLGEFGKAKGSRAIWYMWLGARFLEFEALGFLNEDHWFSRGNSLSGVEGEGLHRLGYILRDVGKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKSIQHLTATEEIAVQNWLARVGRERLSRMAISGDDCVVKPIDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 3998 - protein, 3291 aa, Artificial Sequence
  derived and/or modified protein sequence (wt) from DENV-2__EU482748__SS-prME
TAGVIVMLIPTAMAFHLTTRNGEPHMIVGRQEKGKSLLFKTEDGVNMCTLMAIDLGELCEETITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVQPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEITDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDLCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRIGTKHAILLVAVSFVTLITGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVEKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGIFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIKTEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRKWCFDGIKNNQILEENMEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTSTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMEALQRKYGGALVRNPLSRNSTHEMYWVSNATGNIVSSVNMISRMLINRFTMKHKKTTYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDGRFWELVDRERNLHLEGKCETCVYNMMGKREKKLGEFGKAKGSRAIWYMWLGARFLEFEALGFLNEDHWFSRGNSLSGVEGEGLHRLGYILRDVSKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKSIQHLTATEEIVVQNWLARVGRERLSRMAISGDDCVVKPIDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 3999 - protein, 3291 aa, Artificial Sequence
  derived and/or modified protein sequence (wt) from DENV-2__EU482749__SS-prME
TAGVIVMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQTIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLSEEQDKRFICKHSMVDRGWGNGCGLFGKGGIVTCAMFTCKKNMEGKVVQPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEITDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAMVQADSGCVVSWKNKELKCGSGIFITDNVHTWTEQYKFQPESPSKLASAIQKAHEEGICGIRSVTRLENLMWKQITPELNHILSENEVKLTIMTGDIRGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDLCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRIGTKHAILLVAVSFVTLITGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVEKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGIFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTTAIKTEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRKWCFDGIKNNQILEENMEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMEALQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDGRFWELVDRERNLHLEGKCETCVYNMMGKREKKLGEFGKAKGSRAIWYMWLGARFLEFEALGFLNEDHWFSRGNSLSGVEGEGLHRLGYILRDVGKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKSIQHLTATEEIAVQNWLARVGRERLSRMAISGDDCVVKPIDDRFASALTALNDMGKIRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 4000 - protein, 3291 aa, Artificial Sequence
  derived and/or modified protein sequence (wt) from DENV-2__EU482751__SS-prME
TAGVIVMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVQPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEITDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAVVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRIGTKHAILLVAVSFVTLITGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVEKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGIFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIKTEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRKWCFDGIKNNQILEENMEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTSTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMEALQRQYGGALVRNPLSRNSTHEMYWVSNATGNIVSSVNMISRMLINRFTMKHKKATYEPDVDLGSGTRNIGIESEIPNLDIIGKRIEKIKQEHEISWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDGRFWELVDRERNLHLEGKCETCVYNMMGKREKKLGEFGKAKGSRAIWYMWLGARFLEFEALGFLNEDHWFSRGNSLSGVEGEGLHRLGYILRDVGKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKSIQHLTATEEIAVQNWLARVGRERLSRMAISGDDCVVKPIDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQAAINQVRSLIGNEEYTDYMPSMKRFRREEEEAGVLW

SEQ ID NO: 4001 - protein, 3291 aa, Artificial Sequence
  derived and/or modified protein sequence (wt) from DENV-2__GQ868604__SS-prME
TAGVIVMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVQPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEITDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAVVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDLCEGTTVVVTEDCGNRGPSLRTTTASGKLITEWCCRSCTLPPLRYRGEDGCWYGMEIRPLKEKEENLVNSLVTAGRGQIDNFSLGVLGMALFLEEMLRTRIGTKHAILLVAVSFVTLITGNMSFRDLGRVMVMVGATMTDDIGMGVTYLALLAAFKVRPTFAAGLLLRKLTSKELMMATIGIALLSQSTIPENILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVEKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGIFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIKTEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRKWCFDGIKNNQILEENMEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTSTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMEALQRQYGGALVRNPLSRNSTHEMYWVSNATGNIVSSVNMISRMLINRFTMKHKKATYEPDVDLGSGTRNIGIESEIPNLDIIGKRIEKIKQEHEISWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTKKVRSNAALGAIFTDENKWKSAREAVEDGRFWELVDRERNLHLEGKCETCVYNMMGKREKKLGEFGKAKGSRAIWYMWLGARFLEFEALGFLNEDHWFSRGNSLSGVEGEGLHRLGYILRDVGKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKSIQHLTATEEIAVQNWLARVGRERLSRMAISGDDCVVKPIDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 4002 - protein, 3291 aa, Artificial Sequence
  derived and/or modified protein sequence (wt) from DENV-2__EU482752__SS-prME
TAGVIVMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVQPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEITDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAMVQADSGCVVSWKNKELKCGSGIFITDNVHTWTEQYKFQPESPSKLASAIQKAHEEGICGIRSVTRLENLMWKQITPELNHILSENEVKLTIMTGDIRGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDLCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRIGTKHAILLVAVSFVTLITGNMSFRDLGRVMVMVGATMTDDIGMGVTYLALLAAFKVRPTFAAGLLLRKLTSKELMMATIGIALLSQSTIPENILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVEKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGIFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTTAIKTEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRKWCFDGIKNNQILEENMEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMEALQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDGRFWELVDRERNLHLEGKCETCVYNMMGKREKKLGEFGKAKGSRAIWYMWLGARFLEFEALGFLNEDHWFSRGNSLSGVEGEGLHRLGYILRDVGKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKSIQHLTATEEIAVQNWLARVGRERLSRMAISGDDCVVKPIDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 4003 - protein, 3291 aa, Artificial Sequence
  derived and/or modified protein sequence (wt) from DENV-2__EU482753__SS-prME
TAGVIVMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVQPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEITDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAMVQADSGCVVSWKNKELKCGSGIFITDNVHTWTEQYKFQPESPSKLASAIQKAHEEGICGIRSVTRLENLMWKQITPELNHILSENEVKLTIMTGDIRGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDLCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRIGTKHAILLVAVSFVTLITGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVEKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGIFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTTAIKTEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRKWCFDGIKNNQILEENMEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMEALQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDGRFWELVDRERNLHLEGKCETCVYNMMGKREKKLGEFGKAKGSRAIWYMWLGARFLEFEALGFLNEDHWFSRGNSLSGVEGEGLHRLGYILRDVGKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKSIQHLTATEEIAVQNWLARVGRERLSRMAISGDDCVVKPIDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSMIGLTSRATWAKNIQTAINQVRSLIGNEEYTDYMPSMKRFRREEEEAGVLW

SEQ ID NO: 4004 - protein, 3291 aa, Artificial Sequence
  derived and/or modified protein sequence (wt) from DENV-2__EU482680__SS-prME
TAGVIVMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKIVQPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEITDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAMVQADSGCVVSWKNKELKCGSGIFITDNVHTWTEQYKFQPESPSKLASAIQKAHEEGICGIRSVTRLENLMWKQITPELNHILSENEVKLTIMTGDIRGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDLCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRIGTKHAILLVAVSFVTLITGNMSFRDLGRVMVMVGATMTDDIGTGVTYLALLAAFKVRPTFAAGLLLRKLTSKELMMATIGIALLSQSTIPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVEKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGIFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTTAIKTEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRKWCFDGIKNNQILEENMEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMEALQRKYGGALVRNPLSRNSTHEMYWVSNATGNIVSSVNMISRMLINRFTMKHKKATYEPDVDLGSGTRNIGIESEKPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDGRFWELVDRERNLHLEGKCETCVYNMMGKREKKLGEFGKAKGSRAIWYMWLGARFLEFEALGFLNEDHWFSRGNSLSGVEGEGLHRLGYILRDVGKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKSIQHLTATEEIAVQNWLARVGRERLSRMAISGDDCVVKPIDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 4005 - protein, 3291 aa, Artificial Sequence
  derived and/or modified protein sequence (wt) from DENV-2__EU482754__SS-prME
TAGVIVMLIPTAMAFHLTTRNGEPHMIVGRQEKGKSLLFKTEDGVNMCTLMAMDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVQPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEITDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAMVQADSGCVVSWKNKELKCGSGIFITDNIHTWTEQYKFQPESPSKLASAIQKAHEEGICGIRSVTRLENLMWKQITPELNHILSENEVKLTIMTGDIRGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDLCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRIGTKHAILLVAVSFVTLITGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVEKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGIFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTTAIKTEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRKWCFDGIKNNQILEENMEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMEALQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDGRFWELVDRERNLHLEGKCETCVYNMMGKREKKLGEFGKAKGSRAIWYMWLGARFLEFEALGFLNEDHWFSRGNSLSGVEGEGLHRLGYILRDVGKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKSIQHLTATEEIAVQNWLARVGRERLSRMAISGDDCVVKPIDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 4006 - protein, 3291 aa, Artificial Sequence
  derived and/or modified protein sequence (wt) from DENV-2__FJ478455__SS-prME
TAGVIVMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVQPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEITDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAVVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETVECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRIGTKHAILLVAVSFVTLITGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVEKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGIFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIKTEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRKWCFDGIKNNQILEENMEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTSTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMEALQRQYGGALVRNPLSRNSTHEMYWVSNATGNIVSSVNMISRMLINRFTMKHKKATYEPDVDLGSGTRNIGIESEIPNLDIIGKRIEKIKQEHEISWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDGRFWELVDRERNLHLEGKCETCVYNMMGKREKKLGEFGKAKGSRAIWYMWLGARFLEFEALGFLNEDHWFSRGNSLSGVEGEGLHRLGYILRDVGKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKSIQHLTATEEIAVQNWLARVGRERLSRMAISGDDCVVKPIDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQAAINQVRSLIGNEEYTDYMPSMKRFRREEEEAGVLW

SEQ ID NO: 4007 - protein, 3291 aa, Artificial Sequence
  derived and/or modified protein sequence (wt) from DENV-2__EU482756__SS-prME
TAGVIVMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVQPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEITDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAMVQADSGCVVSWKNKELKCGSGIFITDNVHTWTEQYKFQPESPSKLASAIQKAHEEGICGIRSVTRLENLMWKQITPELNHILSENEVKLTIMTGDIRGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDLCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRIGTKYAILLVAVSFVTLITGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVEKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGIFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTTAIKTEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRKWCFDGIKNNQILEENMEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMEALQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDGRFWELVDRERNLHLEGKCETCVYNMMGKREKKLGEFGKAKGSRAIWYMWLGARFLEFEALGFLNEDHWFSRGNSLSGVEGEGLHRLGYILRDVGKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKSIQHLTATEEIAVQNWLARVGRERLSRMAISGDDCVVKPIDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 4008 - protein, 3291 aa, Artificial Sequence
  derived and/or modified protein sequence (wt) from DENV-2__EU482757__SS-prME
TAGVIVMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVQPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEITDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDLCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRIGTKHAILLVAVSFVTLITGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVEKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGIFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIKTEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRKWCFDGIKNNQILEENMEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTSTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMEALQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDGRFWELVDRERNLHLEGKCETCVYNMMGKREKKLGEFGKAKGSRAIWYMWLGARFLEFEALGFLNEDHWFSRGNSLSGVEGEGLHRLGYILRDVSKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKSIQHLTATEEIVVQNWLARVGRERLSRMAISGDDCVVKPIDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 4009 - protein, 3291 aa, Artificial Sequence
  derived and/or modified protein sequence (wt) from DENV-2__FJ906956__SS-prME
TAGVIVMLIPTAMAFHLTTRNGEPHMIVGKQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVQPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEITDLEKRHVLGRLITVNPIVTGKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAMVQADSGCVVSWKNKELKCGSGIFITDNVHTWTEQYKFQPESPSKLASAIQKAHEEGICGIRSVTRLENLMWKQITPELNHILSENEVKLTIMTGDIRGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMVIPKNFAGPVSQHNYRPGYHTQTAGPWHLGKLEMDFDLCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRIGTKHAILLVAVSFVTLITGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVEKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGIFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTTAIKTEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKRVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRKWCFDGIKNNQILEENMEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMEALQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDGRFWELVDRERNLHLEGKCETCVYNMMGKREKKLGEFGKAKGSRAIWYMWLGARFLEFEALGFLNEDHWFSRGNSLSGVEGEGLHRLGYILRDVGKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKSIQHLTATEEIAVQNWLARVGRERLSRMAISGDDCVVKPIDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHANHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 4010 - protein, 3291 aa, Artificial Sequence
  derived and/or modified protein sequence (wt) from DENV-2__EU482759__SS-prME
TAGVIVMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVQPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEITDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAMVQADSGCVVSWKNKELKCGSGIFITDNVHTWTEQYKFQPESPSKLASAIQKAHEEGICGIRSVTRLENLMWKQITPELNHILSENEVKLTIMTGDIRGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDLCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRIGTKHAILLVAVSFVTLITGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVEKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGIFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVRGAIKRGLRTLILAPTRVVAAEMEEALRGLPIRYQTTAIKTEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRKWCFDGIKNNQILEENMEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMEALQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDGRFWELVDRERNLHLEGKCETCVYNMMGKREKKLGEFGKAKGSRAIWYMWLGARFLEFEALGFLNEDHWFSRGNSLSGVEGEGLHRLGYILRDVGKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKSIQHLTATEEIAVQNWLARVGRERLSRMAISGDDCVVKPIDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 4011 - protein, 3291 aa, Artificial Sequence
  derived and/or modified protein sequence (wt) from DENV-2__EU482760__SS-prME
TAGVIVMLIPTAMAFHLTTRNGEPHMIVGRQEKGKSLLFKTEDGVNMCTLMAIDLGELCEDTITYKCPLLRQNEPEDIDCWCNSTSTWVTYGTCATTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVQPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEITDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAMVQADSGCVVSWKNKELKCGSGIFITDNVHTWTEQYKFQPESPSKLASAIQKAHEEGICGIRSVTRLENLMWKQITPELNHILSENEVKLTIMTGDIRGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDLCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRIGTKHAILLVAVSFVTLITGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVEKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGIFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTTAIKTEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRKWCFDGIKNNQILEENMEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMEALQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDGRFWELVDRERNLHLEGKCETCVYNMMGKREKKLGEFGKAKGSRAIWYMWLGARFLEFEALGFLNEDHWFSRGNSLSGVEGEGLHRLGYILRDVGKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKSIQHLTATEEIAVQNWLARVGRERLSRMAISGDDCVVKPIDDRFASALTALNDMGKIRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 4012 - protein, 3291 aa, Artificial Sequence
  derived and/or modified protein sequence (wt) from DENV-2__EU482762__SS-prME
TAGVIVMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVQPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEITDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAMVQADSGCVVSWKNKELKCGSGIFITDNVHTWTEQYKFQPESPSKLASAIQKAHEEGICGIRSVTRLENLMWKQITPELNHILSENEVKLTIMTGDIRGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCYWPKSHTLWSNGVLESEMIIPKNFAGPVSQHNYRPGYHTQTAGPWHLGKLEMDFDLCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRIGTKHAILLVAVSFVTLITGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVEKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGIFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTTAIKTEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRKWCFDGIKNNQILEENMEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMEALQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDGRFWELVDRERNLHLEGKCETCVYNMMGKREKKLGEFGKAKGSRAIWYMWLGARFLEFEALGFLNEDHWFSRGNSLSGVEGEGLHRLGYILRDVGKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKSIQHLTATEEIAVQNWLARVGRERLSRMAISGDDCVVKPIDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 4013 - protein, 3291 aa, Artificial Sequence
  derived and/or modified protein sequence (wt) from DENV-2__EU482763__SS-prME
TAGVIVMLIPTAMAFHLTTRNGEPHMIVGRQEKGKSLLFKTEDGVNMCTLMAMDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVQPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEITDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAMVQADSGCVVSWKNKELKCGSGIFITDNVHTWTEQYKFQPESPSKLASAIQKAHEEGICGIRSVTRLENLMWKQITPELNHILSENEVKLTIMTGDIRGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDLCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRIGTKHAILLVAVSFVTLITGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVEKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGIFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTTAIKTEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYTDRKWCFDGIKNNQILEENMEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMEALQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDGRFWELVDRERNLHLEGKCETCVYNMMGKREKKLGEFGKAKGSRAIWYMWLGARFLEFEALGFLNEDHWFSRGNSLSGVEGEGLHRLGYILRDVGKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKSIQHLTATEEIAVQNWLARVGRERLSRMAISGDDCVVKPIDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 4014 - protein, 3291 aa, Artificial Sequence
  derived and/or modified protein sequence (wt) from DENV-2__EU482444__SS-prME
TAGVIVMLIPTAMAFHLTTRNGEPHMIVGRQEKGKSLLFKTEDGVNMCTLMAMDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVQPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEITDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAMVQADSGCVVSWKNKELKCGSGIFITDNVHTWTEQYKFQPESPSKLASAIQKAHEEGICGIRSVTRLENLMWKQITPELNHILSENEVKLTIMTGDIRGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDLCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRIGTKHAILLVAVSFVTLITGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVEKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGIFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTTAIKTEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRKWCFDGIKNNQILEENMEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITIQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMEALQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDGRFWELVDRERNLHLEGKCETCVYNMMGKREKKLGEFGKAKGSRAIWYMWLGARFLEFEALGFLNEDHWFSRGNSLSGVEGEGLHRLGYILRDVGKKEGGVMYADDTAGWDTRITLEDLKNEELVTNHMKGEHKKLAEAIFKLTYQNKVVRVQRPTPRGTVMDIISRRDQRGSGQVGTYGLNTFTNMEAQLIRQMEGEGIFKSIQHLTATEEIAVQNWLARVGRERLSRMAISGDDCVVKPIDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 4015 - protein, 3291 aa, Artificial Sequence
  derived and/or modified protein sequence (wt) from DENV-2__EU482684__SS-prME
TAGVIVMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMATILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVQPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEITDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAVVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRIGTKHAILLVAVSFVTLITGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVEKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGIFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIKTEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRKWCFDGIKNNQILEENMEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTSTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMEALQRQYGGALVRNPLSRNSTHEMYWVSNATGNIVSSVNMISRMLINRFTMKHKKATYEPDVDLGSGTRNIGIESEIPNLDIIGKRIEKIKQEHEISWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTKKVRSNAALGAIFTDENKWKSAREAVEDGRFWELVDRERNLHLEGKCETCVYNMMGKREKKLGEFGKAKGSRAIWYMWLGARFLEFEALGFLNEDHWFSRGNSLSGVEGEGLHRLGYILRDVGKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKSIQHLTATEEIAVQNWLARVGRERLSRMAISGDDCVVKPIDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 4016 - protein, 3291 aa, Artificial Sequence
  derived and/or modified protein sequence (wt) from DENV-2__EU482685__SS-prME
TAGVIVMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVQPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEITDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAVVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGNGQIDNFSLGVLGMALFLEEMLRTRIGTKHAILLVAVSFVTLITGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVEKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGIFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIKTEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRKWCFDGIKNNQILEENMEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTSTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVRQVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMEALQRQYGGALVRNPLSRNSTHEMYWVSNATGNIVSSVNMISRMLINRFTMKHKKATYEPDVDLGSGTRNIGIESEIPNLDIIGKRIEKIKQEHEISWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTKKVRSNAALGAIFTDENKWKSAREAVEDGRFWELVDRERNLHLEGKCETCVYNMMGKREKKLGEFGKAKGSRAIWYMWLGARFLEFEALGFLNEDHWFSRGNSLSGVEGEGLHRLGYILRDVGKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKSIQHLTATEEIAVQNWLARVGRERLSRMAISGDDCVVKPIDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 4017 - protein, 3291 aa, Artificial Sequence
  derived and/or modified protein sequence (wt) from DENV-2__EU482687__SS-prME
TAGVIVMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAVLAYTIGTTHFQRALIFVLLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVQPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEITDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAVVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRIGTKHAILLVAVSFVTLITGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVEKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGIFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIKTEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRKWCFDGIKNNQILEENMEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTSTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMEALQRQYGGALVRNPLSRNSTHEMYWVSNATGNIVSSVNMISRMLINRFTMKHKKATYEPDVDLGSGTRNIGIESEIPNLDIIGKRIEKMKQEHEISWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDGRFWELVDRERNLHLEGKCETCVYNMMGKREKKLGEFGKAKGSRAIWYMWLGARFLEFEALGFLNEDHWFSRGNSLSGVEGEGLHRLGYILRDVGKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKSIQHLTATEEIAVQNWLARVGRERLSRMAISGDDCVVKPIDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQAAINQVRSLIGNEEYTDYMPSMKRFRREEEEAGVLW

SEQ ID NO: 4018 - protein, 3291 aa, Artificial Sequence
  derived and/or modified protein sequence (wt) from DENV-2__EU482688__SS-prME
TAGVIVMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVQPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEITDLEKRHVLGRLITVNPIVIEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAMVQADSGCVVSWKNKELKCGSGIFITDNVHTWTEQYKFQPESPSKLASAIQKAHEEGICGIRSVTRLENLMWKQITPELNHILSENEVKLTIMTGDIRGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDLCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRIGTKHAILLVAVSLVTLITGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVEKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGIFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTTAIKTEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRKWCFDGIKNNQILEENMEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGIDVFFTPPEKCDTLLCDIGESSPNPTIEAGRTLRVLNLVENWLNNNTQFCIKVLNPYMPSVIEKMEALQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDGRFWELVDRERNLHLEGKCETCVYNMMGKREKKLGEFGKAKGSRAIWYMWLGARFLEFEALGFLNEDHWFSRGNSLSGVEGEGLHRLGYILRDVGKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKSIQHLTATEEIAVQNWLARVGRERLSRMAISGDDCVVKPIDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSMIGLTSRATWAKNIQTAINQVRSLIGNEEYTDYMPSMKRFRREEEEAGVLW

SEQ ID NO: 4019 - protein, 3291 aa, Artificial Sequence
  derived and/or modified protein sequence (wt) from DENV-2__EU482691__SS-prME
TAGVIVMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVQPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEITDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAVVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNINRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRIGTKHAILLVAVSFVTLITGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVRWEDQAEISGSSPILSITISEDGSMSIKNEEEEQTLTILIRTGLLVISGVFPVSIPITAAAWYLWEVKKQRAGVLWDVPSPPPVEKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGIFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIKTEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYTDRKWCFDGIKNNQILEENMEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTSTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCVKVLNPYMPSVIEKMEALQRQYGGALVRNPLSRNSTHEMYWVSNATGNIVSSVNMISRMLINRFTMKHKKATYEPDVDLGSGTRNIGIESEIPNLDIIGKRIEKIKQEHEISWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDGRFWELVDRERNLHLEGKCETCVYNMMGKREKKLGEFGKAKGSRAIWYMWLGARFLEFEALGFLNEDHWFSRGNSLSGVEGEGLHRLGYILRDVGKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKSIQHLTATEEIAVQNWLARVGRERLSRMAISGDDCVVKPIDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 4020 - protein, 3291 aa, Artificial Sequence
  derived and/or modified protein sequence (wt) from DENV-2__EU482693__SS-prME
TAGVIVMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVQPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEITDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAVVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDLCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRIGTKHATLLVAVSFVTLITGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVEKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGIFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIKTEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRKWCFDGIKNNQILEENMEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTSTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMEALQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDGRFWELVDRERNLHLEGKCETCVYNMMGKREKKLGEFGKAKGSRAIWYMWLGARFLEFEALGFLNEDHWFSRGNSLSGVEGEGLHRLGYILRDVSKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKSIQHLTAAEENVVQNWLARVGRERLSRMAISGDDCVVKPIDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 4021 - protein, 3291 aa, Artificial Sequence
  derived and/or modified protein sequence (wt) from DENV-2__EU596483__SS-prME
TAGVIVMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVQPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEITDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAVVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWMESALNDTWKMEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRIGTKHAILLVAVSFVTLITGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVEKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGIFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIKTEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYTDRKWCFDGIKNNQILEENMEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTSTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMEALQRQYGGALVRNPLSRNSTHEMYWVSNATGNIVSSVNMISRMLINRFTMKHKKATYEPDVDLGSGTRNIGIESEIPNLDIIGKRIEKIKQEHEISWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDGRFWELVDRERNLHLEGKCETCVYNMMGKREKKLGEFGKAKGSRAIWYMWLGARFLEFEALGFLNEDHWFSRGNSLSGVEGEGLHRLGYILRDVGKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKSIQHLTATEEIAVQNWLARVGRERLSRMAISGDDCVVKPIDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEETGVLW

SEQ ID NO: 4022 - protein, 3291 aa, Artificial Sequence
  derived and/or modified protein sequence (wt) from DENV-2__EU482597__SS-prME
TAGVIVMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLSEEQDKRFICKHSMVDRGWGNGCGLFGKGGIVTCAMFTCKKNMEGKVVQPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEITDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAMVQADSGCVVSWKNKELKCGSGIFITDNVHTWTEQYKFQPESPSKLASAIQKAHEEGICGIRSVTRLENLMWKQITPELNHILSENEVKLTIMTGDIRGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDLCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRIGTKHAILLVAVSFVTLITGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVEKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGIFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTTAIKTEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRKWCFDGIKNNQILEENMEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMEALQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDGRFWELVDRERNLHLEGKCETCVYNMMGKREKKLGEFGKAKGSRAIWYMWLGARFLEFEALGFLNEDHWFSRGNSLSGVEGEGLHRLGYILRDVGKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKSIQHLTATEEIAVQNWLARVGRERLSRMAISGDDCVVKPIDDRFASALTALNDMGKIRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 4023 - protein, 3291 aa, Artificial Sequence
  derived and/or modified protein sequence (wt) from DENV-2__EU482598__SS-prME
TAGVIVMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKIVQPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEITDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAMVQADSGCVVSWKNKELKCGSGIFITDNVHTWTEQYKFQPESPSKLASAIQKAHEEGICGIRSVTRLENLMWKQITPELNHILSENEVKLTIMTGDIRGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDLCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRIGTKHAILLVAVSFVTLITGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVEKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGIFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTTAIKTEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRKWCFDGIKNNQILEENMEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMEALQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDGRFWELVDRERNLHLEGKCETCVYNMMGKREKKLGEFGKAKGSRAIWYMWLGARFLEFEALGFLNEDHWFSRGNSLSGVEGEGLHRLGYILRDVGKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKSIQHLTATEEIAVQNWLARVGRERLSRMAISGDDCVVKPIDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 4024 - protein, 3291 aa, Artificial Sequence
  derived and/or modified protein sequence (wt) from DENV-2__EU482603__SS-prME
TAGVIVMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVQPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEITDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAMVQADSGCVVSWKNKELKCGSGIFITDNVHTWTEQYKFQPESPSKLASAIQKAHAEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDLCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRIGTKHAILLVAVSFVTLITGNMSFRDLGRVMVMVGATMTDDIGMGVTYLALLAAFKVRPTFAAGLLLRKLTSKELMMATIGIALLSQSTIPETILELTDALALGMMVLKIVRDMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVEKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGIFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIKTEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRKWCFDGIKNNQILEENMEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTSTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMEALQRKYGGALVRNPLSRNSTHEMYWVSNATGNIVSSVNMISRMLINRFTMKHKKTTYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDGRFWELVDRERNLHLEGKCETCVYNMMGKREKKLGEFGKAKGSRAIWYMWLGARFLEFEALGFLNEDHWFSRGNSLSGVEGEGLHRLGYILRDVSKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKSIQHLTATEEIVVQNWLARVGRERLSRMAISGDDCVVKPIDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 4025 - protein, 3291 aa, Artificial Sequence
  derived and/or modified protein sequence (wt) from DENV-2__EU482599__SS-prME
TAGVIVMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVQPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEITDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAMVQADSGCVVSWKNKELKCGSGIFITDNVHTWTEQYKFQPESPSKLASAIQKAHEEGICGIRSVTRLENLMWKQITPELNHILSENEVKLTIMTGDIRGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDLCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRIGTKHAILLVAVSFVTLITGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLAVTIMVISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVEKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGIFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTTAIKTEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRKWCFDGIKNNQILEENMEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMEALQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDGRFWELVDRERNLHLEGKCETCVYNMMGKREKKLGEFGKAKGSRAIWYMWLGARFLEFEALGFLNEDHWFSRGNSLSGVEGEGLHRLGYILRDVGKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKSIQHLTATEEIAVQNWLARVGRERLSRMAISGDDCVVKPIDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 4026 - protein, 3291 aa, Artificial Sequence
  derived and/or modified protein sequence (wt) from DENV-2__FJ898436__SS-prME
TAGVIVMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVQPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEITDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAMVQADSGCVVSWKNKELKCGSGIFITDNVHTWTEQYKFQPESPSKLASAIQKAHEEGICGIRSVTRLENLMWKQITPELNHILSENEVKLTIMTGDIRGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDLCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRIGTKHAILLVAVSFVTLITGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVEKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGIFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTTAIKTEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRKWCFDGIKNNQILEENMEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMEALQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAAWLWKELGKKKTPRMCTREEFTRKVRSNAALGAIFTDENKWKSAREAVEDGRFWELVDRERNLHLEGKCETCVYNMMGKREKKLGEFGKAKGSRAIWYMWLGARFLEFEALGFLNEDHWFSRGNSLSGVEGEGLHRLGYILRDVGKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKSIQHLTATEEIAVQNWLARVGRERLSRMAISGDDCVVKPIDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 4027 - protein, 3291 aa, Artificial Sequence
  derived and/or modified protein sequence (wt) from DENV-2__EU482634__SS-prME
TAGVIVMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVQPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEITDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAMVQADSGCVVSWKNKELKCGSGIFITDNVHTWTEQYKFQPESPSKLASAIQKAHEEGICGIRSVTRLENLMWKQITPELNHILAENEVKLTIMTGDIKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDLCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRIGTKHAILLVAVSFVTLITGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLAVTIMAISCVPNAVILQNAWKVSCTILAAVSVSPLLLTSSQQKADWIPLALTIKGLNPTAIFLTTLSRTNKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVEKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGIFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIKTEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRKWCFDGIKNNQILEENMEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTSTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTKFCIKVLNPYMPSVIEKMEALQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDGRFWELVDRERNLHLEGKCETCVYNMMGKREKKLGEFGKAKGSRAIWYMWLGARFLEFEALGFLNEDHWFSRGNSLSGVEGEGLHRLGYILRDVSKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKSIQHLTATEEIVVQNWLARVGRERLSRMAISGDDCVVKPIDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 4028 - protein, 3291 aa, Artificial Sequence
  derived and/or modified protein sequence (wt) from DENV-2__EU482635__SS-prME
TAGVIVMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLSEEQDKRFICKHSMVDRGWGNGCGLFGKGGIVTCAMFTCKKNMEGKVVQPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEITDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAMVQADSGCVVSWKNKELKCGSGIFITDNVHTWTEQYKFQPESPSKLASAIQKAHEEGICGIRSVTRLENLMWKQITPELNHILSENEVKLTIMTGDIRGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDLCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRIGTKHAILLVAVSFVTLITGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVEKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGIFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTTAIKTEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRKWCFDGIKNNQILEENMEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTSTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMEALQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDGRFWELVDRERNLHLEGKCETCVYNMMGKREKKLGEFGKAKGSRAIWYMWLGARFLEFEALGFLNEDHWFSRGNSLSGVEGEGLHRLGYILRDVSKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKSIQHLTATEEIAVQNWLARVGRERLSRMAISGDDCVVKPIDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 4029 - protein, 3291 aa, Artificial Sequence
  derived and/or modified protein sequence (wt) from DENV-2__GQ199874__SS-prME
TAGVIVMLIPTAMAFHLTTRNGEPHMIVGRQEKGKSLLFKTEDGVNMCTLMAMDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVQPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEITDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAMVQADSGCVVSWKNKELKCGSGIFITDNVHTWTEQYKFQPESPSKLASAIQKAHEEGICGIRSVTRLENLMWKQITPELNHILSENEVKLTIMTGDIRGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDLCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRIGTKHAILLVAVSFVTLITGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVEKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGIFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTTAIKTEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRKWCFDGIKNNQILEENMEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMEALQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDGRFWELVDRERNLHLEGKCETCVYNMMGKREKKLGEFGKAKGSRAIWYMWLGARFLEFEALGFLNEDHWFSRGNSLSGVEGEGLHRLGYILRDVGKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKSIQHLTATEEIAVQNWLARVGRERLSRMAISGDDCVVKPIDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 4030 - protein, 3291 aa, Artificial Sequence
  derived and/or modified protein sequence (wt) from DENV-2__EU482639__SS-prME
TAGVIVMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVQPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEITDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAMVQADSGCVVSWKNKELKCGSGIFITDNVHTWTEQYKFQPESPSKLASAIQKAHEEGICGIRSVTRLENLMWKQITPELNHILSENEVKLTIMTGDIRGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDLCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRIGTKHAILLVAVSFVTLITGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVEKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGIFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTTAIKTEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRKWCFDGIKNNQILEENMEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTLVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCETLLCDIGESSPNPTIEAGRTLRVLNLVENWLNNNTQFCIKVLNPYMPSVIEKMEALQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDGRFWELVDRERNLHLEGKCETCVYNMMGKREKKLGEFGKAKGSRAIWYMWLGARFLEFEALGFLNEDHWFSRGNSLSGVEGEGLHRLGYILRDVGKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKSIQHLTATEEIAVQNWLARVGRERLSRMAISGDDCVVKPIDDRFASALTALNDMGKIRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 4031 - protein, 3291 aa, Artificial Sequence
  derived and/or modified protein sequence (wt) from DENV-2__EU482766__SS-prME
TAGVIVMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVQPENLEYTIVITPHSGEEHAVGNDTGKHGKEIKITPQSSITEAELTGYGTVTMECSSRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEITDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAVVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRIGTKHAILLVAVSFVTLITGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVEKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGIFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIKTEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRKWCFDGIKNNQILEENMEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTSTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMEALQRQYGGALVRNPLSRNSTHEMYWVSNATGNIVSSVNMISRMLINRFTMKHKKATYEPDVDLGSGTRNIGIESEIPNLDIIGKRIEKIKQEHEISWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDGRFWELVDRERNLHLEGKCETCVYNMMGKREKKLGEFGKAKGSRAIWYMWLGARFLEFEALGFLNEDHWFSRGNSLSGVEGEGLHRLGYILRDVGKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKSIQHLTATEEIAVQNWLARVGRERLSRMAISGDDCVVKPIDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 4032 - protein, 3291 aa, Artificial Sequence
  derived and/or modified protein sequence (wt) from DENV-2__EU482695__SS-prME
TAGVIVMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVQPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEITDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAMVQADSGCVVSWKNKELKCGSGIFITDNVHTWTEQYKFQPESPSKLASAIQKAHEEGICGIRSVTRLENLMWKQITPELNHILSENEVKLTIMTGDIRGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDLCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRIGTKHAILLVAVSFVTLITGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVEKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGIFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTTAIKTEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRKWCFDGIKNNQILEENMEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMEALQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDGRFWELVDRERNLHLEGKCETCVYNMMGKREKKLGEFGKAKGSRAIWYMWLGARFLEFEALGFLNEDHWFSRGNSLSGVEGEGLHRLGYILRDVGKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKSIQHLTATEEIAVQNWLARVGRERLSRMAISGDDCVVKPIDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 4033 - protein, 3291 aa, Artificial Sequence
  derived and/or modified protein sequence (wt) from DENV-2__EU482769__SS-prME
TAGVIVMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVQPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEITDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAMVQADSGCVVSWKNKELKCGSGIFITDNVHTWTEQYKFQPESPSKLASAIQKAHEEGICGIRSVTRLENLMWKQITPELNHILSENEVKLTIMTGDIRGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDLCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRIGTKHAILLVAVSFVTLITGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVEKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGIFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTTAIKTEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRKWCFDGIKNNQILEENMEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMEALQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDGRFWELVDRERNLHLEGKCETCVYNMMGKREKKLGEFGKAKGSRAIWYMWLGARFLEFEALGFLNEDHWFSRGNSLSGVEGEGLHRLGYILRDVGKKEGGAMYADDTAGWDTRITLEDLKNEEMVTNHMKGEHKKLAEAIFKLTYQNKVVRVQRPTPRGTVMDIISRRDQRGSGQVGTYGLNTFTNMEAQLIRQMEGEGIFKSIQHLTATEEIAVQNWLARVGRERLSRMAISGDDCVVKPIDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSMIGLTSRATWAKNIQTAINQVRSLIGNEEYIDYMPSMKRFRREEEEAGVLW

SEQ ID NO: 4034 - protein, 3291 aa, Artificial Sequence
  derived and/or modified protein sequence (wt) from DENV-2__EU482696__SS-prME
TAGVIVMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVQPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEITDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAMVQADSGCVASWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDLCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRIGTKHATLLVAVSFVTLITGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVEKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGTFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIKTEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRKWCFDGIKNNQILEENMEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTSTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMEALQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDGRFWELVDRERNLHLEGKCETCVYNMMGKREKKLGEFGKAKGSRAIWYMWLGARFLEFEALGFLNEDHWFSRGNSLSGVEGEGLHRLGYILRDVSKKEGGAMYADDTAGWDTRITLEDLKNEEMVTNHMKGEHKKLAEAIFKLTYQNKVVRVQRPTPRGIVMDIISRRDQRGSGQVGTYGLNTFTNMEAQLIRQMEGEGIFKSIQHLTAAEEIVVQNWLARVGRERLSRMAISGDDCVVKPIDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 4035 - protein, 3291 aa, Artificial Sequence
  derived and/or modified protein sequence (wt) from DENV-2__KC294207__SS-prME
TAGVIVMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKIVQPENLEYTIVITPHSGEEHAVGNDTGKHGKEIKITPQSSTTEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYCMCTGKFKIVKEIAETQHGTIVIRVQYEGDGSPCKIPFEITDLEKRHVLGRLITVNPIVTEKDSPVNIEAEPPFGDSYIIVGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAMVQADSGCIVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPGHLGKLEMDFDLCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVALSFVTLITGNMSFRDLGRVMVMVGATMTDDIGMGVTYLALLAAFKVRPTFAAGLLLRKLTSKELMMATIGIALLSQSTLPETILELTDALALGMMALKIVRNMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVGKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGIFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRKWCFDGIKNNQILEENVEVEIWTKEGERKKLKPRWLDARIYSDPLALKEFKEFAAGRKSLTLNLITEMGRLPTFMTQKARNALDNLAVLHTAEVGGKAYTHALSELPETLETLLLLTLLAAVTGGIFLFLMSGKGVGKMTLGMCCIITASILLWYAQIQPHWIAASIILEFFLIVLLIPEPEKQRTPQDNQLTYVVIAILTVVAATMANEMGFLEKTKKDLGFGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNVGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMETLQRKYGGALVRNPLSRNSTHEMYWVSNATGNIVSSVNMISRMLINRFTMKHKKATYEPDVDLGSGTRNIGIESEIPNLDIVGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKEKTPRMCTREEFTRKVRSNAALGAVFTDENKWKSAREAVEDGRFWELVDRERNLHLEGKCETCVYNMMGKREKKLGEFGKAKGSRAIWYMWLGARFLEFEALGFLNEDHWFSRGNSLSGVEGEGLHRLGYILREVGKKEGGAMYADDTAGWDTRITLEDLKNEEMVTNHMKGEHKKLAEAIFKLTYQNKVVRVQRPTPRGTVMDIISRKDQRGSGQVGTYGLNTFTNMEAQLIRQMEGEGIFKSIQHLTATEEIAVQNWLARVGRERLSRMAISGDDCVVKPIDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLVVWNRVWIQENPWMEDKTPVESWEEVPYLGKREDQWCGSLIGLTSRATWAKNIQTAINQVRSLIGNEGYTDYMPSMKRFRREEEEAGVLW

SEQ ID NO: 4036 - protein, 3291 aa, Artificial Sequence
  derived and/or modified protein sequence (wt) from DENV-2__KC294208__SS-prME
TAGVIVMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKIVQPENLEYTIVITPHSGEEHAVGNDTGKHGKEIKITPQSSTTEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEITDLEKRHVLGRLITVNPIVTEKDSPVNIEAEPPFGDSYIIVGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAMVQADSGCIVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVALSFVTLITGNMSFRDLGRVMVMVGATMTDDIGMGVTYLALLAAFKVRPTFAAGLLLRKLTSKELMMATIGIALLSQSTLPETILELTDALALGMMALKIVRNMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVGKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGIFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRKWCFDGIKNNQILEENVEVEIWTKEGERKKLKPRWLDARIYSDPLALKEFKEFAAGRKSLTLNLITEMGRLPTFMTQKARNALDNLAVLHTAEVGGKAYTHALSELPETLETLLLLTLLAAVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGFGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGDPGRFWNTTIAVSMANIFRGSYLAGAGLLFSIMKNTTNTRRGTGNVGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMETLQRKYGGALVRNPLSRNSTHEMYWVSNATGNIVSSVNMISRMLINRFTMKHKKATYEPDVDLGSGTRNIGIESEIPNLDIVGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKEKTPRMCTREEFTRKVRSNAALGAVFTDENKWKSAREAVEDGRFWELVDRERNLHLEGKCETCVYNMMGKREKKLGEFGKAKGSRAIWYMWLGARFLEFEALGFLNEDHWFSRGNSLSGVEGEGLHRLGYILREVGKKEGGAMYADDTAGWDTRITLEDLKNEEMVTNHMKGEHKKLAEAIFKLTYQNKVVRVQRPTPRGTVMDIISRKDQRGSGQVGTYGLNTFTNMEAQLIRQMEGEGIFKSIQHLTATEEIAVQNWLARVGRERLSRMAISGDDCVVKPIDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLVVWNRVWIQENPWMEDKTPVESWEEVPYLGKREDQWCGSLIGLTSRATWAKNIQTAINQVRSLIGNEGYTDYMPSMKRFRREEEEAGVLW

SEQ ID NO: 4037 - protein, 3291 aa, Artificial Sequence
  derived and/or modified protein sequence (wt) from DENV-2__KC294209__SS-prME
TAGVIVMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKIVQPENLEYTIVITPHSGEEHAVGNDTGKHGKEIKITPQSSTTEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEITDLEKRHVLGRLITVNPIVTEKDSPVNIEAEPPFGDSYIIVGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAMVQADSGCIVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVALSFVTLITGNMSFRDLGRVMVMVGATMTDDIGMGVTYLALLAAFKVRPTFAAGLLLRKLTSKELMMATIGIALLSQSTLPETILELTDALALGMMALKIVRNMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVGKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGIFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRKWCFDGIKNNQILEENVEVEIWTKEGERKKLKPRWLDARIYSDPLALKEFKEFAAGRKSLTLNLITEMGRLPTFMTQKARNALDNLAVLHTAEVGGKAYTHALSELPETLETLLLLTLLAAVTGGIFLFLMSGKGVGKMTLGMCCIITASILLWYAQIQPHWIAASIILEFFLIVLLIPEPEKQRTPQDNQLTYVVIAILTVVAATMANEMGFLEKTKKDLGFGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNVGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMETLQRKYGGALVRNPLSRNSTHEMYWVSNATGNIVSSVNMISRMLINRFTMKHKKATYEPDVDLGSGTRNIGIESEIPNLDIVGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKEKTPRMCTREEFTRKVRSNAALGAVFTDENKWKSAREAVEDGRFWELVDRERNLHLEGKCETCVYNMMGKREKKLGEFGKAKGSRAIWYMWLGARFLEFEALGFLNEDHWFSRGNSLSGVEGEGLHRLGYILREVGKKEGGAMYADDTAGWDTRITLEDLKNEEMVTNHMKGEHKKLAEAIFKLTYQNKVVRVQRPTPRGTVMDIISRKDQRGSGQVGTYGLNTFTNMEAQLIRQMEGEGIFKSIQHLTATEEIAVQNWLARVGRERLSRMAISGDDCVVKPIDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLVVWNRVWIQENPWMEDKTPVESWEEVPYLGKREDQWCGSLIGLTSRATWAKNIQTAINQVRSLIGNEGYTDYMPSMKRFRREEEEAGVLW

SEQ ID NO: 4038 - protein, 3291 aa, Artificial Sequence
  derived and/or modified protein sequence (wt) from DENV-2__KC294214__SS-prME
TAGVIVMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKIVQPENLEYTIVITPHSGEEHAVGNDTGKHGKEIKITPQSSTTEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEITDLEKRHVLGRLITVNPIVTEKDSPVNIEAEPPFGDSYIIVGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAMVQADSGCIVSWRNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVALSFVTLITGNMSFRDLGRVMVMVGATMTDDIGMGVTYLALLAAFKVRPTFAAGLLLRKLTSKELMMATIGIALLSQSTLPETILELTDALALGMMALKIVRNMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVGKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGIFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRKWCFDGIKNNQILEENVEVEIWTKEGERKKLKPRWLDARIYSDPLALKEFKEFAAGRKSLTLNLITEMGRLPTFMTQKARNALDNLAVLHTAEVGGKAYTHALSELPETLETLLLLTLLAAVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGFGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNVGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMETLQRKYGGALVRNPLSRNSTHEMYWVSNATGNIVSSVNMISRMLINRFTMKHKKATYEPDVDLGSGTRNIGIESEIPNLDIVGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKEKTPRMCTREEFTRKVRSNAALGAVFTDENKWKSAREAVEDGRFWELVDRERNLHLEGKCETCVYNMMGKREKKLGEFGKAKGSRAIWYMWLGARFLEFEALGFLNEDHWFSRGNSLSGVEGEGLHRLGYILREVGKKEGGAMYADDTAGWDTRITLEDLKNEEMVTNHMKGEHKKLAEAIFKLTYQNKVVRVQRPTPRGTVMDIISRKDQRGSGQVGTYGLNTFTNMEAQLIRQMEGEGIFKSIQHLTTTEEIAVQNWLARVGRERLSRMAISGDDCVVKPIDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLVVWNRVWIQENPWMEDKTPVESWEEVPYLGKREDQWCGSLIGLTSRATWAKNIQTAINQVRSLIGNEGYTDYMPSMKRFRREEEEAGVLW

SEQ ID NO: 4039 - protein, 3291 aa, Artificial Sequence
  derived and/or modified protein sequence (wt) from DENV-2__KC294205__SS-prME
TAGVIVMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKIVQPENLEYTIVITPHSGEEHAVGNDTGKHGKEIKITPQSSTTEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEITDLEKRHVLGRLITVNPIVTEKDSPVNIEAEPPFGDSYIIVGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAMVQADSGCIVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVALSFVTLITGNMSFRDLGRVMVMVGATMTDDIGMGVTYLALLAAFKVRPTFAAGLLLRKLTSKELMMATIGIALLSQSTLPETILELTDALALGMMALKIVRNMEKYQLAVTIMAISCVPNAVILQNAWKVSCTILAAVSVSPLLLTSSHQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVGKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGIFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRKWCFDGIKNNQILEENVEVEIWTKEGERKKLKPRWLDARIYSDPLALKEFKEFAAGRKSLTLNLITEMGRLPTFMTQKARNALDNLAVLHTAEVGGKAYTHALSELPETLETLLLLTLLAAVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGFGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNVGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNTNTQFCIKVLNPYMPSVIEKMETLQRKYGGALVRNPLSRNSTHEMYWVSNATGNIVSSVNMISRMLINRFTMKHKKATYEPDVDLGSGTRNIGIESEIPNLDIVGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKEKTPRMCTREEFTRKVRSNAALGAVFTDENKWKSAREAVEDGRFWELVDRERNLHLEGKCETCVYNMMGKREKKLGEFGKAKGSRAIWYMWLGARFLEFEALGFLNEDHWFSRGNSLSGVEGEGLHRLGYILREVGKKEGGAMYADDTAGWDTRITLEDLKNEEMVTNHMKGEHKKLAEAIFKLTYQNKVVRVQRPTPRGTVMDIISRKDQRGSGQVGTYGLNTFTNMEAQLIRQMEGEGIFKSIQHLTATEEIAVQNWLARVGRERLSRMAISGDDCVVKPIDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLVVWNRVWIQENPWMEDKTPVESWEEVPYLGKREDQWCGSLIGLTSRATWAKNIQTAINQVRSLIGNEGYTDYMPSMKRFRREEEEAGVLW

SEQ ID NO: 4040 - protein, 3291 aa, Artificial Sequence
  derived and/or modified protein sequence (wt) from DENV-2__KC294210__SS-prME
TAGVIVMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKIVQPENLEYTIVITPHSGEEHAVGNDTGKHGKEIKITPQSSTTEAELTGYGTVMMESSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEITDLEKRHVLGRLITVNPIVTEKDSPVNIEAEPPFGDSYIIVGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAMVQADSGCIVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVALSFVTLITGNMSFRDLGRVMVMVGATMTDDIGMGVTYLALLAAFKVRPTFAAGLLLRKLTSKELMMATIGIALLSQSTLPETILELTDALALGMMALKIVRNMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVGKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGIFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRKWCFDGIKNNQILEENVEVEIWTKEGERKKLKPRWLDARIYSDPLALKEFKEFAAGRKSLTLNLITEMGRLPTFMTQKARNALDNLAVLHTAEVGGKAYTHALSELPETLETLLLLTLLAAVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGFGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNVGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMETLQRKYGGALVRNPLSRNSTHEMYWVSNATGNIVSSVNMISRMLINRFTMKHKKATYEPDVDLGSGTRNIGIESEIPNLDIVGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKEKTPRMCTREEFTRKVRSNAALGAVFTDENKWKSAREAVEDGRFWELVDRERNLHLEGKCETCVYNMMGKREKKLGEFGKAKGSRAIWYMWLGARFLEFEALGFLNEDHWFSRGNSLSGVEGEGLHRLGYILREVGKKEGGAMYADDTAGWDTRITLEDLKNEEMVTNHMKGEHKKLAEAIFKLTYQNKVVRVQRPTPRGTVMDIISRKDQRGSGQVGTYGLNTFTNMEAQLIRQMEGEGIFKSIQHLTATEEIAVQNWLVRVGRERLSRMAISGDDCVVKPIDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLVVWNRVWIQENPWMEDKTPVESWEEVPYLGKREDQWCGSLIGLTSRATWAKNIQTAINQVRSLIGNEGYTDYMPSMKRFRREEEEAGVLW

SEQ ID NO: 4041 - protein, 3291 aa, Artificial Sequence
  derived and/or modified protein sequence (wt) from DENV-2__KC294215__SS-prME
TAGVIVMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKIVQPENLEYTIVITPHSGEEHAVGNDTGKHGKEIKITPQSSTTEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEITDLEKRHVLGRLITVNPIVTEKDSPVNIEAEPPFGDSYIIVGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAMVQADSGCIVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVALSFVTLITGNMSFRDLGRVMVMVGATMTDDIGMGVTYLALLAAFKVRPTFAAGLLLRKLTSKELMMATIGIALLSQSTLPETILELTDALALGMMALKIVRNMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVGKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGIFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRKWCFDGIKNNQILEENVEVEIWTKEGERKKLKPRWLDARIYSDPLALKEFKEFAAGRKSLTLNLITEMGRLPTFMTQKARNALDNLAVLHTAEVGGKAYTHALSELPETLETLLLLTLLAAVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGFGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNVGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMETLQRKYGGALVRNPLSRNSTHEMYWVSNATGNIVSSVNMISRMLINRFTMKHKKATYEPDVDLGSGTRNIGIESEIPNLDIVGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAKWLWKELGKEKTPRMCTREEFTRKVRSNAALGAVFTDENKWKSAREAVEDGRFWELVDRERNLHLEGKCETCVYNMMGKREKKLGEFGKAKGSRAIWYMWLGARFLEFEALGFLNEDHWFSRGNSLSGVEGEGLHRLGYILREVGKKEGGAMYADDTAGWDTRITLEDLKNEEMVTNHMKGEHKKLAEAIFKLTYQNKVVRVQRPTPRGTVMDIISRKDQRGSGQVGTYGLNTFTNMEAQLIRQMEGEGIFKSIQHLTATEEIAVQNWLARVGRERLSRMAISGDDCVVKPIDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLVVWNRVWIQENPWMEDKTPVESWEEVPYLGKREDQWCGSLIGLTSRATWAKNIQTAINQVRSLIGNEGYTDYMPSMKRFRREEEEAGVLW

SEQ ID NO: 4042 - protein, 3291 aa, Artificial Sequence
  derived and/or modified protein sequence (wt) from DENV-2__KC294216__SS-prME
TAGVIIMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFAIMAAILAYTIGTTHFQRALIFILLTAVAPSMTMRCIGISNRDFVEGVSGGSWVDIVLEHGSCVTTMAKNKPTLDLELIKTEAKQPATLRKYCIEAKLTNTTTESRCPTQGEPSLNEEQDKRFICKHSMVDRGWGNGCGLFGKGGIVTCAMFTCKKNMEGKVVLPENLEYTIVITPHSGEEHAVGNDTGKHGEEIKITPQSSITEAELTGYGTVTMECSPRTGLDFNEMVLLQMEEKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEIMDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFLTLITGNMSFRDLGRVMVMVGVAMTDDIGMGVTYLALLAAFKVRPTFAAGLLLRKLTSKELMMATIGITLLSQSTTPETILELTDALALGMMVLKIVRNMEKYQLAVTIMTISCVPNAMILINAWKVSCTILAVVSVSPLLLTSSQQKTDWIPLALTIKGLNPTAIFLTTLSRTSKKRSWPLNEAVMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVRKQRAGVLWDVPSPPPVEKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGLFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFRAERVIDPRRCMKPVILTDGEERVILAGPMPVTHSSAAQRRGRVGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGIKNNQILEENVEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKRDLGLGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKRSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMETLQRKYGGALVRNPLSRNSTHEMYWVSNATGNIVSSVNMISRMLINRFTMKHKKATYEPDVDLGSGTRNIGIESEIPNLAIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMRITAEWLWKELGKKKTPRMCTREEFTRKVRSNAALGAIFTDENKWKSAREAVEDSRFWELVDRERNLHLEGKCETCVYNMMGKREKKLGEFGKAKGSRAIWYMWLGARFLEFEALGFLNEDHWFSRGNSLSGVEGEGLHRLGYILRDVSKKEGGAMYADDTAGWDTRITLEDLKNEEMVTNHMKGEHKKLAEAVFKLTYQNKVVRVQRPTPRGTVMDIISRRDQRGSGQVGTYGLNTFTNMEAQLIRQMEGEGIFKSIQHLTATEEIAVQNWLARVGRERLSRMAISGDDCVVKPLDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 4043 - protein, 3291 aa, Artificial Sequence
  derived and/or modified protein sequence (wt) from DENV-2__KC294218__SS-prME
TAGVIVMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALILILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKIVQPENLEYTIVITPHSGEEHAVGNDTGKHGKEIKITPQSSTTEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEITDLEKRHVLGRLITVNPIVTEKDSPVNIEAEPPFGDSYIIVGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAMVQADSGCIVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVALSFVTLITGNMSFRDLGRVMVMVGATMTDDIGMGVTYLALLAAFKVRPTFAAGLLLRKLTSKELMMATIGIALLSQSTLPETILELTDALALGMMALKIVRNMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVGKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGIFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRKWCFDGIKNNQILEENVEVEIWTKEGERKKLKPRWLDARIYSDPLALKEFKEFAAGRKSLTLNLITEMGRLPTFMTQKARNALDNLAVLHTAEVGGKAYTHALSELPETLETLLLLTLLAAVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGFGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNVGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMETLQRKYGGALVRNPLSRNSTHEMYWVSNATGNIVSSVNMISRMLINRFTMKHKKATYEPDVDLGSGTRNIGIESEIPNLDIVGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKEKTPRMCTREEFTRKVRSNAALGAVFTDENKWKSAREAVEDGRFWELVDRERNLHLEGKCETCVYNMMGKREKKLGEFGKAKGSRAIWYMWLGARFLEFEALGFLNEDHWFSRGNSLSGVEGEGLHRLGYILREVGKKEGGAMYADDTAGWDTRITLEDLKNEEMVTNHMKGEHKKLAEAIFKLTYQNKVVRVQRPTPRGTVMDIISRKDQRGSGQVGTYGLNTFTNMEAQLIRQMEGEGIFKSIQHLTATEEIAVQNWLARVGRERLSRMAISGDDCVVKPIDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLVVWNRVWIQENPWMEDKTPVESWEEVPYLGKREDQWCGSLIGLTSRATWAKNIQTAINQVRSLIGNEGYTDYMPSMKRFRREEEEAGVLW

SEQ ID NO: 4044 - protein, 3291 aa, Artificial Sequence
  derived and/or modified protein sequence (wt) from DENV-2__KC294220__SS-prME
TAGVIVMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKIVQPENLEYTIVITPHSGEEHAVGNDTGKHGKEIKITPQSSTTEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEITDLEKRHVLGRLITVNPIVTEKDSPVNIEAEPPFGDSYIIVGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAMVQADSGCIVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVALSFVTLITGNMSFRDLGRVMVMVGATMTDDIGMGVTYLALLAAFKVRPTFAAGLLLRKLTSKELMMATIGIALLSQSTLPETILELTDALALGMMALKIVRNMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVGKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGIFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRKWCFDGIKNNQILEENVEVEIWTKEGERKKLKPRWLDARIYSDPLALKEFKEFAAGRKSLTLNLITEMGRLPTFMTQKARNALDNLAVLHTAEVGGKAYTHALSELPETLETLLLLTLLAAVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGFGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNVGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEMCDTLLCDIGESSPNPTIEAGRTLRVLNLVENWLNNNTQFCIKVLNPYMPSVIEKMETLQRKYGGALVRNPLSRNSTHEMYWVSNATGNIVSSVNMISRMLINRFTMKHKKATYEPDVDLGSGTRNIGIESEIPNLDIVGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKEKTPRMCTREEFTRKVRSNAALGAVFTDENKWKSAREAVEDGRFWELVDRERNLHLEGKCETCVYNMMGKREKKLGEFGKAKGSRAIWYMWLGARFLEFEALGFLNEDHWFSRGNSLSGVEGEGLHRLGYILREVGKKEGGAMYADDTAGWDTRITLEDLKNEEMVTNHMKGEHKKLAEAIFKLTYQNKVVRVQRPTPRGTVMDIISRKDQRGSGQVGTYGLNTFTNMEAQLIRQMEGEGIFKSIQHLTATEEIAVQNWLARVGRERLSRMAISGDDCVVKPIDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLVVWNRVWIQENPWMEDKTPVESWEEVPYLGKREDQWCGSLIGLTSRATWAKNIQTAINQVRSLIGNEGYTDYMPSMKRFRREEEEAGVLW

SEQ ID NO: 4045 - protein, 3291 aa, Artificial Sequence
  derived and/or modified protein sequence (wt) from DENV-2__KC294221__SS-prME
TAGVIVMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKIVQPENLEYTIVITPHSGEEHAVGNDTGKRGKEIKITPQSSTTEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEITDLEKRHVLGRLITVNPIVTEKDSPVNIEAEPPFGDSYIIVGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAMVQADSGCIVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFSTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVALSFVTLITGNMSFRDLGRVMVMVGATMTDDIGMGVTYLALLAAFKVRPTFAAGLLLRKLTSKELMMATIGIALLSQSTLPETILELTDALALGMMALKIVRNMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVGKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGIFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRKWCFDGIKNNQILEENVEVEIWTKEGERKKLKPRWLDARIYSDPLALKEFKEFAAGRKSLTLNLITEMGRLPTFMTQKARNALDNLAVLHTAEVGGKAYTHALSELPETLETLLLLTLLAAVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGFGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNVGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMETLQRKYGGALVRNPLSRNSTHEMYWVSNATGNIVSSVNMISRMLINRFTMKHKKATYEPDVDLGSGTRNIGIESEIPNLDIVGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKEKTPRMCTREEFTRKVRSNAALGAVFTDENKWKSAREAVEDGRFWELVDRERNLHLEGKCETCVYNMMGKREKKLGEFGKAKGSRAIWYMWLGARFLEFEALGFLNEDHWFSRGNSLSGVEGEGLHRLGYILREVGKKEGGAMYADDTAGWDTRITLEDLKNEEMVTNHMKGEHKKLAEAIFKLTYQNKVVRVQRPTPRGTVMDIISRKDQRGSGQVGTYGLNTFTNMEAQLIRQMEGEGIFKSIQHLTATEEIAVQNWLARVGRERLSRMAISGDDCVVKPIDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLVVWNRVWIQENPWMEDKTPVESWEEVPYLGKREDQWCGSLIGLTSRATWAKNIQTAINQVRSLIGNEGYTDYMPSMKRFRREEEEAGVLW

SEQ ID NO: 4046 - protein, 3291 aa, Artificial Sequence
  derived and/or modified protein sequence (wt) from DENV-2__KC294223__SS-prME
TAGVIVMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKIVQPENLEYTIVITPHSGEEHAVGNDTGKHGKEIKITPQSSTTEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEITDLEKRHVLGRLITVNPIVTEKDSPVNIEAEPPFGDSYIIVGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGAMVQADSGCIVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVALSFVTLITGNMSFRDLGRVMVMVGATMTDDIGMGVTYLALLAAFKVRPTFAAGLLLRKLTSKELMMATIGIALLSQSTLPETILELTDALALGMMALKIVRNMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVGKAELEDGAYRIKQRGILGYSQIGAGVYKEGTFHTMWHVTRGAVLMHRGKRIEPSWADVKKDLISYGGGWKLEGEWKEGEEVQVLALEPGKNPRAVQTKPGIFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRKWCFDGIKNNQILEENVEVEIWTKEGERKKLKPRWLDARIYSDPLALKEFKEFAAGRKSLTLNLITEMGRLPTFMTQKARNALDNLAVLHTAEVGGKAYTHALSELPETLETLLLLTLLAAVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGFGSITTQESESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNVGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMETLQRKYGGALVRNPLSRNSTHEMYWVSNATGNIVSSVNMISRMLINRFTMKHKKATYEPDVDLGSGTRNIGIESEIPNLDIVGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKEKTPRMCTREEFTRKVRSNAALGAVFTDENKWKSAREAVEDGRFWELVDRERNLHLEGKCETCVYNMMGKREKKLGEFGKAKGSRAIWYMWLGARFLEFEALGFLNEDHWFSRGNSLSGVEGEGLHRLGYILREVGKKEGGAMYADDTAGWDTRITLEDLKNEEMVTNHMKGEHKKLAEAIFKLTYQNKVVRVQRPTPRGTVMDIISRKDQRGSGQVGTYGLNTFTNMEAQLIRQMEGEGIFKSIQHLTATEEIAVQNWLARVGRERLSRMAISGDDCVVKPIDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLVVWNRVWIQENPWMEDKTPVESWEEVPYLGKREDQWCGSLIGLTSRATWAKNIQTAINQVRSLIGNEGYTDYMPSMKRFRREEEEAGVLW

SEQ ID NO: 4047 - protein, 3291 aa, Artificial Sequence
  derived and/or modified protein sequence (wt) from DENV-2__FJ906959__SS-prME
TAGMIIMLIPTVMAFHLTTRNGEPHMIVSRQEKGKSLLFKTEDGVNMCTLMAMDLGELCEDTITYKCPFLKQNEPEDIDCWCNSTSTWVTYGTCTTTGEHRREKRSVALVPHVGMGLETRTETWMSSEGAWKHAQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTDSRCPTQGEPSLNEEQDKRFVCKHSMVDRGWGNGCGLFGKGGIVTCAMFTCKKNMKGKVVQPENLEYTIVITPHSGEEHAVGNDTGKHGKEIKITPQSSITEAELTGYGTVTMECSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRHVLGRLITVNPIVTEKDSPVNIEAEPPFGDSYIIIGVEPGQLKLNWFKKGSSIGQMIETTMRGAKRMAILGDTAWDFGSLGGVFTSIGKALHQVFGAIYGAAFSGVSWIMKILIGVIITWIGMNSRSTSLSVSLVLVGVVTLYLGVMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLQPQPTELKYSWKTWGKAKMLSTESHNQTFLIDGPETAECPNTNRAWNSLEVEDYGFGVFTTNIWLKLREKQDVFCDSKLMSAAIKDNRAVHADMGYWIESALNDTWKIEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMTTIGIVLLSQSTIPETILELTDALALGMMVLKMVRKMEKYQLAVTIMAILCVPNAVILQNAWKVSCTILAVVSVSPLFLTSSQQKADWIPLALTIKGLNPTAIFLTTLSRTNKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGLFPVSIPITAAAWYLWEVKKQRAGVLWDVPSPPPVGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNAGTIGAVSLDFSPGTSGSPIIDKKGKVVGLYGNGVVTRSGAYVSAIAQTEKSIEDNPEIEDDIFRKRKLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWSSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGIKNNQILEENVEVEIWTKEGERKKLKPRWLDARIYSDPLALKEFKEFAAGRKSLTLNLITEMGRLPTFMTQKARDALDNLAVLHTAEAGGRAYNHALSELPETLETLLLLTLLATVTGGIFLFLMSGRGIGKMTLGMCCIITASILLWYAQIQPHWIAASIILEFFLIVLLIPEPEKQRTPQDNQLTYVVIAILTVVAATMANEMGFLEKTKKDLGLGSITTQQPESNILDIDLRPASAWTLYAVATTFVTPMLRHSIENSSVNVSLTAIANQATVLMGLGKGWPLSKMDIGVPLLAIGCYSQVNPITLTAALFLLVAHYAIIGPGLQAKATREAQKRAAAGIMKNPTVDGITVIDLDPIPYDPKFEKQLGQVMLLVLCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKSIQHLTVTEEIAVQNWLARVGRERLSRMAISGDDCVVKPLDDRFASALTALNDMGKVRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIQENPWMEDKTPVESWEEIPYLGKREDQWCGSLIGLTSRATWAKNIQTAINQVRSLIGNEEYTDYMPSMKRFRREEEEAGVLW

SEQ ID NO: 4048 - protein, 3291 aa, Artificial Sequence
  derived and/or modified protein sequence (wt) from DENV-2__KF360005__SS-prME
TAGVIIMRIPTAMAFHLTTRNGEPHMIVSKQEKGKSLLFKTEDGVNMCTLMAMDLGELCEDTITYNCPLLRQNEPEDIDCWCNSTSTWVTYGTCTATGEHRREKRSVALVPHVGMGLETRTETWMSSEGAWKHAQRIETWILRHPGFTIMAAILAYTIGTTYFQRVLIFILLTAVAPSMTMRCIGISNRDFVEGVSGGSWVDIVLEHGSCVTTMAKNKPTLDFELIKTEAKQPATLRKYCIEAKLTNTTTASRCPTQGEPSLNEEQDKRFVCKHSMVGRGWGDGCGLFGKGGIVTCAMFTCKKNMEGKIVQPENLEYTIVVTPHSGEENAVGNDTGKHGKEIKVTPQSSITEAELTGYGTVTMECSPRTGLDFNEMVLLQMENKAWLVHRQWFLDLPLPWLPGADIQGSNWIQKETLVTFKNPHAKKQDVVVLGSQEGALHTALTGATEIQMSSGNLLFTGHLKCRLRMDKLQLKGMSYSMCTGKFKVVKEIAETQHGTIVVRIQYEGDGSPCKIPFEIMDLEKRHVLGRLITVNPIVTEKDSPVNIEAEPPFGDSYIIIGVEPGQLKLSWFKKGSSIGQMFETTMRGAKRMAILGDTAWDFGSLGGVFTSIGKALHQVFGAIYGAAFSGVSWTMKILIGVVITWIGMNSRSTSLSVSLVLVGVVTLYLGVMVQADSGCVVSWRNKELKCGSGIFITDNVHTWTEQYKFQPESPSKLASAIQKAHEEGICGIRSVTRLENLMWKQITPELNHILSENEVKLSIMTGDIKGIMQAGKRSLRPQPTELKYSWKTWGKAKMLSTEPHNQTFLIDGPETAECPNTNRAWNSLEVEDYGFGVFTTNIWLKLKERQDVFCDSKLMSAAIKDNRAVHADMGYWIESALNDTWKIEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAVLLVAVSFMTLITGNMSFRDLGRVMVMVGAAMTDDIGMGVTYLALLAAFKVRPTFAAGLLLRKLTSKELMMTTIGIVLLSQSTTPETILELTDALALGMMILKIVRNMEKYQLAVTIMAILCVPNAVILQNAWKVSCTILAAVSVSPLLLTSSQQKADWIPLALTIKGLNPTAIFLTTLSRTNKKRSWPLNEAIMAVGMVSILASSLLKNDIPMTGPLVAGGLLTVCYVLTGRSADLELERAADVRWEDQAEVSGSSPILSITISEDGSMSIKNEEEEQTLTILIRTGLLVISGLFPVSIPITAAAWYLWEVKKQRAGVLSAVPSPPPVGKAELEDGAYRIKQKGILGYSQIGAGVYKEGTFHTMWHVTRGAVLMHKGKRIEPSWADVRKDLISYGGGRKLEGEWKEGEEVQVLALEPGKNPRAVQTKPGLFKTNTGTIGAVSLDFSPGASGSPIVDKKGKVVGLYGNGVVTRSGTYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYIKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGIKNNQILEENVEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDFGLGSIATQQPESNILDIDLRPASAWTLYAVATTFITPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTADGITVIDLDPIPYDPKFEKQLGQVMLLVLCVTQVLMMRTTWALCEALTLATGPISTLWEGSPGRFWNTTIAVSMANIFRGSYLAGAGLLFSIMKNTTNTRRGTGNTGETLGEKWKNRLNSLGKSEFQIYKRSGIQEVDRTLAKEGIKRGETDHHAVSRGSAKLRWFVERNLVTPEGKVVDLGCGRGGWSYYCGGLKNVREVRGLTKGGPGHEEPIPMSTYGWNLVRLQSGVDVFFTPPEKCDTLLCDIGESSPNPTVEAGRTLRVLNLVENWLNNNTQFCIKVLNPYMPSVIEKMETLQRKYGGALVRNPLSRNSTHEMYWVSNASGNIVSSVNMISRMLINRFTMRHKKATYEPDVDLGSGTRNIGIESETPNLDIIGKRIEKIKQEHETSWHYDQDHPYKTWAYHGSYETKQTGSASSVVNGVVRLLTKPWDVIPMVTQMAMTDTTPFGQQRVFKEKVDTRTQEPKEGTKKLMKITAEWLWKELGKKKTPRMCTREEFARKVRSNAALGAIFTDENKWKSAREAVEDSRFWELVDKERNLHLEGKCETCVYNMMGKREKKIGEFGKAKGSRAVWYMWLGARFLEFEALGFLNEDHWFSRENSLSGVEGEGLHKLGYILREVSKKEGGAMYADDTAGWDTRITLEDLKNEEMVTNHMEGEHKKLAEAIFKLTYQNKVVRVQRPTPRGTVMDIISRRDQRSSGQVGTYGLNTFTNMGAQLIRQMEGEGVFKGIQHLTATEEVAVQDWLARVGRERLSRMAISGDDCVVKPLDDRFASALTALNDMGKVRKDIQQWEPSRGWNDWTQVPFCSHHFHELIMKDGRVLVVPCRNQDELIGRARISQGAGWSLRETACLGKSYAQMWSLMYFHRRGLRLAANAICSAVPSHWVPTSRTTWSIHARHEWMTTEDMLTVWNRVWIQENPWMEDKTPVESWEEIPYLGKRGDQWCGSLIGLTSRATWARNIQTAINRVRSLIGSEGYTDYMPSMKRFRREEDEAGVLW

SEQ ID NO: 4049 - protein, 3291 aa, Artificial Sequence
  derived and/or modified protein sequence (wt) from DENV-2__KJ010185__SS-prME
TAGVIIMLIPTAMAFHLTTRNGEPHMIVSKQEKGKSLLFKTEDGVNMCTLMAMDLGELCEDTITYNCPLLRQNEPEDIDCWCNATSTWVTYGTCTATGEHRREKRSVALVPHVGMGLETRTETWMSSEGAWKHAQRIETWILRHPGFTIMAAILAYTIGTTYFQRVLIFILLTAVAPSMTMRCIGISNRDFVEGVSGGSWVDIVLEHGSCVTTMAKNKPTLDFELIKTEAKQPATLRKYCIEAKLTNTTTASRCPTQGEPSLNEEQDKRFVCKHSMVDRGWGNGCGLFGKGGIVTCAMFTCKKNMEGKIVQPENLEYTIVVTPHSGEENAVGNDTGKHGKEIKVTPQSSITEAELTGYGTVTMECSPRTGLDFNEMVLLQMENKAWLVHRQWFLDLPLPWLPGADIQGSNWIQKETLVTFKNPHAKKQDVVVLGSQEGAMHTALTGATEIQMSSGNPLFTGHLKCRLRMDKLQLKGMSYSMCTGKFKVVKEIAETQHGTIVVRIQYEGDGSPCKIPFEIMDLEKRHVLGRLITVNPIVTEKDSPVNIEAEPPFGDSYIIIGVEPGQLKLSWFKKGSSIGQMFETTMRGAKRMAILGDTAWDFGSLGGVFTSIGKALHQVFGAIYGAAFSGVSWTMKILIGVVITWIGMNSRSTSLSVSLVLVGVVTLYLGVMVQADSGCVVSWKNKELKCGSGIFFTDNVHTWTEQYKFQPESPSKLASAIQKAHEEGICGIRSITRLDNLMWKQITPELNHILSENEVKLSIMTGDIKGIMQAGKRSLRPQPTELKYSWKTWGKAKMLSTEPHNQTFLIDGPETAQCPNTNRAWNSLEVEDYGFGVFTTNIWLKLKERQDVFCDSKLMSAAIKDNRAVHADMGYWIESALNDTWKIEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAVLLVAVSFMTLITGNMSFRDLGRVMVMVGAAMTDDIGMGVTYLALLAAFKVRPTFAAGLLLRKLTSKELMMTTIGIVLLSQSTTPETILELTDALALGMMILKIVRNMEKYQLAVTIMAILCVPNAVILQNAWKVSCTILAAVSVSPLLLTSSQQKADWIPLALTIKGLNPTAIFLTTLSRTNKKRSWPLNEAIMAVGMVSILASSLLKNDIPMTGPLVAGGLLTVCYVLTGRSADLELERAADVRWEDQAEISGSSPILSITISEDGSMSIKNEEEEQTLTILIRTGLLVISGLFPVSIPITAAAWYLWEVKKQRAGVLWDVPSPPPVGKAELEDGAYRIKQKGILGYSQIGAGVYKEGTFHTMWHVTRGAVLMHKGKRIEPSWADVRKDLISYGGGWKLEGEWKEGEEVQVLALEPGKNPRAVQTKPGLFKTNTGTIGAVSLDFSPGTSGSPIVDKKGKVVGLYGNGVVTRSGTYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYIKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGIKNNQILEENVEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDFGLGSIATQQPESNILDIDLRPASAWTLYAVATTFITPMLRHSIENSSVNVSLTAIANQATVLMGLGKGWPLSKMDIGVPLLAIGCYSQVNPITLTAALLLLVAHYAIIGPGLQAKASREAQKRAAAGIMKNPTVDGITVIDLDPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNTGETLGEKWKNRVSLLGKSEFQIYKRSGIQEVDRTLAKEGIKRGETDHHAVSRGSAKLRWFVERNLVTPEGKVVDLGCGRGGWSYYCGGLKNVREVKGLTKGGPGHEEPIPMSTYGWNLVRLLTGADVFFTPPEKCDTLLCDIGESSPNPTVEAGRTLRVLNLVENWLNNNTQFCIKVLNPYMPSVIEKMETLQRKYGGALVRNPLSRNSTHEMYWVSNASGNIVSSVNMISRMLINRFTMRHKKATYDPDVDLGSGTRNIGIESETPNLDIIGKRIEKIKQEHETSRHYDQDHPYKTWAYHGSYETKQTGSASSTVNGVVRLLTKPWDVIPMVTQMAMTDTTPFGQQRVFKEKVDTRTQEPKEGTKKLMKITAEWLWKELGKKKTPRMCTREEFARKVRSNAALGAIFTDENKWKSAREAVEDSRFWELVDKERNLHLEGKCETCVYNMMGKREKKIGEFGKAKGSRAIWYMWLGARFLEFEALGFLNEDHWFSRENSLSGVEGEGLHKLGYILREVSKKEGGAMYADDTAGWDTRITLEDLKNEEMVTNHMEGEHKKLAEAIFKLTYQNKVVRVQRPTPRGTVMDIISRRDQRGSVQVGTYGLGTFTNMGAQLIRQMEGEGVFKGIQHLTATEEVAVQDWLARVGRERLSRMAISGDDCVVKPLDDRFASALTALNDMGKVRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAGHEWMTTEDMLTVWNRVWIQENPWMEDKTPVESWEEIPYLGKREDQWCGSLIGLTSRATWARNIQTAINQVRSLIGSEEYTDYMPSMKRFGREEEEAGVLW

SEQ ID NO: 4050 - protein, 3291 aa, Artificial Sequence
  derived and/or modified protein sequence (wt) from DENV-2__KJ010186__SS-prME
TAGVIIMLIPTAMAFHLTTRNGEPHMIVSKQEKGKSLLFKTEDGVNMCTLMAMDLGELCEDTITYNCPLLRQNEPEDIDCWCNATSTWVTYGTCTATGEHRREKRSVALVPHVGMGLETRTETWMSSEGAWKHAQRIETWILRHPGFTIMAAILAYTIGTTYFQRVLIFILLTAVAPSMTMRCIGISNRDFVEGVSGGSWVDIVLEHGSCVTTMAKNKPTLDFELIKTEAKQPATLRKYCIEARLTNTTTASRCPTQGEPSLNEEQDKRFVCKHSMVDRGWGNGCGLFGKGGIVTCAMFTCKKNMEGKIVQPENLEYTIVVTPHSGEENAVGNDTGKHGKEIKVTPQSSITEAELTGYGTVTMECSPRTGLDFNEMVLLQMENKAWLVHRQWFLDLPLPWLPGADIQGSNWIQKETLVTFKKPHAKKQDVVVLGSQEGAMHTALTGATEIQMSSGNLLFTGHLKCRLRMDKLQLKGMSYSMCTGKFKVVKEIAETQHGTIVVRVQYEGDGSPCKIPFEIMDLEKRHVLGRLITVNPIVTEKDSPVNIEAEPPFGDSYIIIGVEPGQLKLSWFKKGSSIGQMFETTMRGAKRMAILGDTAWDFGSLGGVFTSIGKALHQVFGAIYGAAFSGVSWTMKILIGVVITWIGMNSRSTSLSVSLVLVGVVTLYLGVMVQADSGCVVSWKNTALKCGSGIFITDNVHTWTEQYKFQPESPSKLASAIQKAHEEGICGIRSVTRLENLMWKQITPELNHILSENEVKLSIMTGDIKGILQAGKRSLRPQPTELKYSWKTWGKAKMLSTESHNQTFLIDGPETAECPNTNRAWNSLEVEDYGFGVFTTNIWLKLKERQDVFCDSKLMSAAIKDNRAVHADMGYWIESALNDTWKIEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAVLLVAVSFMTLITGNMSFRDLGRVMVMVGAAMTDDIGMGVTYLALLAAFKVRPTFAAGLLLRKLTSKELMMTTIGIVLLSQSTTPETILELTDALALGMMILKIVRNMEKYQLAVTIMAILCVPNAVILQNAWKVSCTILAAVSVSPLLLTSSQQKADWIPLALTIKGLNPTAIFLTTLSRTNKKRSWPLNEAIMAVGMVSILASSLLKNDIPMTGPLVAGGLLTVCYVLTGRSADLELERAADVRWEDQAEISGSSPILSITISEDGSMSIKNEEEEQTLTILIRTGLLVISGLFPVSIPITAAAWYLWEVKKQRAGVLWDVRSYPPVGKAELEDGAYRIKQKGILGYSQIGAGVYKEGTFHTMWHVTRGAVLMHKGKRIEPSWADVRKDLISYGGGWKLEGEWKEGEEVQVLALEPGKNPRAVQTKPGLFKTNTGTIGAVSLDFSPGTSGSPIVDKKGKVVGLYGNGVVTRSGTYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYIKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGIKNNQILEENVEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDFGLGSIATQQPESNILDIDLRPASAWTLYAVATTFITPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLVLCVTQVLMMRTTWALCEALTLATGPISTLWEGNPGRFWNTTIAVSMANIFRGSYLAGAGLLFSIMKNTTNTRRGTGNTGETLGEKWKNRLNSLGKSEFQIYKRSGIQEVDRTLAKEGIKRGETDHHAVSRGSAKLRWFVERNLVTPEGKVVDLGCGRGGWSYYCGGLKNVREVKGLTKGGPGHEEPIPMSTYGWNLVRLQSGVDVFFTPPEKCDTLLCDIGESSPNPTVEAGRTLRVLNLVENWLNNNTQFCIKVLNPYMPSVIEKMETLQRKYGGALVRNPLSRNSTHEMYWVSNASGNIVSSVNMISRMLINRFTMRHKKATYEPDVDLGSGTRNIGIESETPNLDIIGKRIEKIKQEHETSWHYDQDHPYKTWAYHGSYETKQTGSASSMVNGVVRLLTKPWDVIPMVTQMAMTDTTPFGQQRVFKEKVDTRTQEPKEGTKKLMKITAEWLWKELGKKKTPRMCTREEFARKVRSNAALGAIFTDENKWKSAREAVEDSRFWELVDKERNLHLEGKCETCVYNMMGKREKKIGEFGKAKGSRAIWYMWLGARFLEFEALGFLNEDHWFSRENSLSGVEGEGLHKLGYILREVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMGAQLIRQMEGEGVFKGIQHLTATEEVAVQDWLARVGRERLSRMAISGDDCVVKPLDDRFANALTALNDMGKVRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHARHEWMTTEDMLTVWNRVWIQENPWMEDKTPVESWEEIPYLGKREDQWCGSLIGLTSRATWARNIQTAINQVRSLIGSEEYTDYMPSMKRFRREEEEAGVLW

SEQ ID NO: 4051 - protein, 3291 aa, Artificial Sequence
  derived and/or modified protein sequence (wt) from DENV-2__KF955364__SS-prME
TAGVIIMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFICKHSMVDRGWGNGCGLFGKGGIVTCAMFTCKKNMEGKVVLPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEIMDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGVMVQADTGCVVSWKNKELKCGSGIFITDNVHTWTEQYKFQPESPSKLASAIQKAHEEGICGIRSVTRLENLMWKQITPELNHILSENGVKLTIMTGDIKGIMQAGKRSLRPQPTELKYSWKTWGKAKMLSTESHNQTFLIDGPETAECPNTNRAWNSLEVEDYGFGVFSTNIWLKLREKQDVLCDSKLMSAAIKDNRAVHADMGYWIESALNDTWKMEKASFIEIKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKYAILLVAVSFVTLITGNMSFRDLGRVMVMVGATMTDDIGMGVTYLALLAAFKVRPTFAAGLLLRKLTSKELMMATIGIALLSQSTIPETILELTDALALGMMVLKIVRNMEKYQLAVTIMAISCVPNAVILQNAWKVSCTILAAVSVSPLLLTSSQQKADWIPLALTIKGLNPTAIFLTTLSRTSKKRSWPLNEAVMAVGMVSILASSLLKNDIPMTGPLVAGGLLTVCYVLTGRSADLELERAADVKWEDQAEISGSSPILSITISEDGSMSIKNEEEEHTLTILIRTGLLVISGVFPVSIPITAAAWYLWEVKKQRAGVLWDVPSPPPVGKAELEDGAYRIKQRGIFGYSQIGAGVYKEGTFHTMWHVTRGAVLMHRGKRIEPSWADVKKDLISYGGGWKLEGEWKEGEEVQVLALEPGKNPRAVQTKPGLFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRANDWDFVVTTDISEMGANFRAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGIKNNQILEENVEVEIWTKEGERKKLKPRWLDARIYSDPLALKEFKEFAAGRKSLTLNLITEMGRLPTFMTQKARDALDNLAVLHTAEVGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGSITTQESESNILDIDLRPASAWTLYAVATTFVTPMLRHSIENSSVNVSLTAIANQATVLMGLGRGWPLSKMDIGVPLLAIGCYSQVNPITLTAALLLLVAHYAIIGPGLQAKATREAQKRTAAGIMKNPTVDGITVIDLEPIPYDPKFEKQLGQVMLLVLCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCVKVLNPYMPSVIEKMETLQRKYGGALVRNPLSRNSTHEMYWVSNATGNIVSSVNMISRMLINRFTMKHKKATYEPDVDLGSGTRNIGIENEIPNLDIIGKRIEKIKQEHETSWHYDQDHPYKTWAYHGSYETKQTGSASSMVNGVVKLLTKPWDVVPMVTQMAMTDTTPFGQQRVFKEKVDTRTQEPKEGTKKLMRITAEWLWKELGKKKTPRMCTREEFTRKVRSNAALGAIFTDENKWKSAREAVEDSRFWELVDRERNLHLEGKCETCVYNMMGKREKKLGEFGKAKGSRAIWYMWLGARFLEFEALGFLNEDHWFSRGNSLSGVEGEGLHKLGYILRDVSKKEGGAMYADDTAGWDTRITLEDLKNEEMVTNHMKGEHKKLAEAIFKLTYQNKVVRVQRPTPRGTVMDIISRKDQRGSGQVGTYGLNTFTNMEAQLIRQMEGEGIFKSIQRLTVTEEIAVQNWLARVGRERLSRMAISGDDCVVKPLDDRFASALTALNDMGKVRKDIQQWEPSRGWNDWTQVPFCSHHFHELVMKDGRVLVVPCRNQDELIGRARISQGAGWSLKETACLGKSYAQMWTLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRKEEEEAGVLW
